US011802292B2

(12) United States Patent
Bell et al.

(10) Patent No.: US 11,802,292 B2
(45) Date of Patent: Oct. 31, 2023

(54) MODIFIED ORTHOPOXVIRUS VECTORS

(71) Applicants: OTTAWA HOSPITAL RESEARCH INSTITUTE, Ottawa (CA); TURNSTONE BIOLOGICS CORP., La Jolla, CA (US)

(72) Inventors: John C. Bell, Ottawa (CA); Fabrice Le Boeuf, Gatineau (CA); Michael S. Huh, Gatineau (CA); Matthew Y. Tang, Orleans (CA); Adrian Pelin, Ottawa (CA); Brian Andrew Keller, Ottawa (CA); Caroline J. Breitbach, Somerville, MA (US); Michael F. Burgess, Chester, NJ (US); Steven H. Bernstein, Lawrenceville, NJ (US)

(73) Assignees: OTTAWA HOSPITAL RESEARCH INSTITUTE, Ottawa (CA); TURNSTONE BIOLOGICS CORP., La Jolla, CA (US)

( * ) Notice: Subject to any disclaimer, the term of this patent is extended or adjusted under 35 U.S.C. 154(b) by 191 days.

(21) Appl. No.: 16/959,632

(22) PCT Filed: Jan. 4, 2019

(86) PCT No.: PCT/CA2019/050014
§ 371 (c)(1),
(2) Date: Jul. 1, 2020

(87) PCT Pub. No.: WO2019/134048
PCT Pub. Date: Jul. 11, 2019

(65) Prior Publication Data

US 2020/0392535 A1 Dec. 17, 2020

Related U.S. Application Data

(60) Provisional application No. 62/784,371, filed on Dec. 21, 2018, provisional application No. 62/614,349, filed on Jan. 5, 2018.

(51) Int. Cl.

| | |
|---|---|
| ***C12N 15/86*** | (2006.01) |
| ***A61K 35/768*** | (2015.01) |
| ***C07K 14/545*** | (2006.01) |
| ***C12N 7/00*** | (2006.01) |
| ***C12N 9/22*** | (2006.01) |

(52) U.S. Cl.
CPC ............ *C12N 15/86* (2013.01); *A61K 35/768* (2013.01); *C07K 14/545* (2013.01); *C12N 7/00* (2013.01); *C12N 9/22* (2013.01); *C12N 2710/24121* (2013.01); *C12N 2710/24132* (2013.01); *C12Y 306/01023* (2013.01)

(58) Field of Classification Search
None
See application file for complete search history.

(56) References Cited

U.S. PATENT DOCUMENTS

| | | | |
|---|---|---|---|
| 2016/0235793 A1 | 8/2016 | Thome | |
| 2020/0385758 A1 | 12/2020 | Bell et al. | |
| 2022/0056480 A1 | 2/2022 | Bell et al. | |
| 2022/0380799 A1 | 12/2022 | Bell et al. | |
| 2023/0022757 A1 | 1/2023 | Bell et al. | |

FOREIGN PATENT DOCUMENTS

| | | | |
|---|---|---|---|
| CN | 105255840 A | 1/2016 | |
| EC | SP 09-9035 | 12/2007 | |
| EC | SP 10010657 A | 2/2011 | |
| EC | SP 19070336 A | 10/2019 | |
| JP | 2002-514885 | 5/2002 | |
| JP | 2006-506974 | 3/2006 | |
| JP | 2016-527920 | 9/2016 | |
| RU | 2621868 | 6/2017 | |
| WO | WO 1992015672 A1 | 9/1992 | |
| WO | WO 1995027780 A2 | 10/1995 | |
| WO | WO 2004014314 A2 | 2/2004 | |
| WO | WO-2004014314 A2 * | 2/2004 | ........... A61K 35/768 |
| WO | WO 2004034995 A2 | 4/2004 | |
| WO | WO 2007147528 A1 | 12/2007 | |
| WO | WO 2008113078 A1 | 9/2008 | |
| WO | WO 2015027163 A1 | 2/2015 | |
| WO | WO 2015027163 A9 | 2/2015 | |
| WO | WO 2016008976 A1 | 1/2016 | |
| WO | WO 2017120670 A1 | 7/2017 | |
| WO | WO 2017209053 A1 | 12/2017 | |
| WO | WO 2018160540 A1 | 9/2018 | |
| WO | WO 2019014623 A1 | 1/2019 | |
| WO | WO 2019089755 A1 | 5/2019 | |
| WO | WO 2019134049 A1 | 7/2019 | |

(Continued)

OTHER PUBLICATIONS

Perdiguero et al., PLoS ONE, 2012, 7(10): e48524. (Year: 2012).*
Dasgupta et al., Molecular Therapy, 2006, 13(1):183-193. (Year: 2006).*
Barnard et al., 2012, "Expression of FMS-like tyrosine kinase 3 ligand by oncolytic herpes simplex virus type I prolongs survival in mice bearing established syngeneic intracranial malignant glioma," Neurosurgery, 71(3):741-748.
Bateman et al., 2002, "Viral fusogenic membrane glycoproteins kill solid tumor cells by nonapoptotic mechanisms that promote cross presentation of tumor antigens by dendritic cells," Cancer Res., 62(22):6566-6578.
Burles et al., 2014, "Initial characterization of vaccinia virus B4 suggests a role in virus spread," Virology, 456-457:108-120.

(Continued)

*Primary Examiner* — Nicole Kinsey White
(74) *Attorney, Agent, or Firm* — Jones Day

(57) ABSTRACT

The disclosure relates to modified orthopoxvirus vectors, as well as methods of using the same for the treatment of various cancers. The disclosure provides modified orthopoxvirus vectors that exhibit various beneficial therapeutic activities, including enhanced oncolytic activity, spread of infection, immune evasion, tumor persistence, capacity for incorporation of exogenous DNA sequences and safety. The viruses we have discovered are also amenable to large scale manufacturing protocols.

50 Claims, 48 Drawing Sheets

Specification includes a Sequence Listing.

(56) References Cited

FOREIGN PATENT DOCUMENTS

| | | | |
|---|---|---|---|
| WO | WO 2020124273 | A1 | 6/2020 |
| WO | WO 2020124274 | A1 | 6/2020 |

OTHER PUBLICATIONS

Curran et al., 2009, "Tumor vaccines expressing flt3 ligand synergize with ctla-4 blockade to reject preimplanted tumors," Cancer Res., 69(19):7747-7755.
De Graaf et al., 2018, "Armed oncolytic viruses: A kick-start for anti-tumor immunity," Cytokine Growth Factor Rev., 41:28-39.
Dobson et al., 2015, "Redundancy complicates the definition of essential genes for vaccinia virus," J Gen Virol., 96(11):3326-3337.
Fagan-Garcia et al., 2011, "A vaccinia virus deletion mutant reveals the presence of additional inhibitors of NF-kappaB," J Virol., 85(2):883-894 (Epub 2010).
Foloppe et al., 2008, "Targeted delivery of a suicide gene to human colorectal tumors by a conditionally replicating vaccinia virus," Gene Ther., 15(20):1361-1371.
Gerlic et al., 2013, "Vaccinia virus FIL protein promotes virulence by inhibiting inflammasome activation," Proc Natl Acad Sci USA, 110(19):7808-7813.
Goebel et al., 1990, "The complete DNA sequence of vaccinia vims," Virology, 179(1):247-266.
International Preliminary Report on Patentability Chapter II for International Patent Application No. PCT/CA2019/050014 (Pub No. WO 2019134048) completed Mar. 31, 2020 (176 pages).
International Preliminary Report on Patentability Chapter II for International Patent Application No. PCT/CA2019/050015 (Pub No. WO 2019134049) completed Mar. 31, 2020 (30 pages).
International Search Report and Written Opinion for International Patent Application No. PCT/CA2019/050014 (Pub No. WO 2019134048) dated Mar. 21, 2019 (22 pages).
International Search Report and Written Opinion for International Patent Application No. PCT/CA2019/050015 (Pub No. WO 2019134049) dated Mar. 7, 2019 (8 pages).
International Search Report and Written Opinion for International Patent Application No. PCT/CA2019/051898 (Pub No. WO 2020124273) dated Apr. 7, 2020 (11 pages).
International Search Report and Written Opinion for International Patent Application No. PCT/CA2019/051899 (Pub No. WO 2020124274) dated Apr. 3, 2020 (13 pages).
Lee et al., 1992, "Molecular attenuation of vaccinia virus: mutant generation and animal characterization," J Virol., 66(5):2617-2630.
Melana et al., 2005, "Molecular characterization of Jurkat cells persistently infected with vaccinia virus mutant vp811," Intervirology, 48(2-3):89-96.
Perkus et al., 1991, "Deletion of 55 open reading frames from the termini of vaccinia virus," Virology, 180(1):406-410.
Rintoul et al., 2011, "A selectable and excisable marker system for the rapid creation of recombinant poxviruses," PLoS One, 6(9):e24643 (12 pages).
Sumner et al., 2014, "Vaccinia virus inhibits NF-κB-dependent gene expression downstream of p65 translocation," J Virol., 88(6):3092-3102 (Epub 2013).
Taylor et al., 2006, "The vaccinia virus protein FIL interacts with Bim and inhibits activation of the pro-apoptotic protein Bax," J Biol Chem, 281(51):39728-39739.
Van Der Jeught et al., 2015, "Targeting the tumor microenvironment to enhance antitumor immune responses," Oncotarget, 6(3):1359-1381 (Epub 2014).
Verardi et al., 2001, "Vaccinia virus vectors with an inactivated gamma interferon receptor homolog gene (B8R) are attenuated In vivo without a concomitant reduction in immunogenicity," J Virol., 75(1):11-18.
Veyer et al., 2014, "Analysis of the anti-apoptotic activity of four vaccinia virus proteins demonstrates that B13 is the most potent inhibitor in isolation and during viral infection," J Gen Virol., 95(Pt 12):2757-2768.
Vom Berg et al., 2013, "Intratumoral IL-12 combined with CTLA-4 blockade elicits T cell-mediated glioma rejection," J Exp Med., 210(13):2803-2811.
Wasilenko et al., 2005, "The vaccinia virus FIL protein interacts with the proapoptotic protein Bak and inhibits Bak activation," J Virol., 79(22):14031-14043.
U.S. Appl. No. 17/415,606, filed Dec. 20, 2019, Bell et al.
U.S. Appl. No. 17/694,115, filed Mar. 14, 2022, Bell et al.
Antoine et al., 1998, "The complete genomic sequence of the modified vaccinia Ankara strain: comparison with other orthopoxvimses," Virology, 244(2):365-396.
Breitbach et al., 2016, "Oncolytic Vimses: Therapeutics With an Identity Crisis," EBioMedicine, 9:31-36.
Dimier et al., May 15, 2011, "Deletion of Major Nonessential Genomic Regions in the Vaccinia Virus Lister Strain Enhances Attenuation without Altering Vaccine Efficacy in Mice," Journal of Virology, 85(10): 5016-5026.
Gomez et al., 2008, "The poxvirus vectors MVA and NYVAC as gene delivery systems for vaccination against infectious diseases and cancer," Curr Gene Ther., 8(2):97-120.
Guo et al., 2017, "Rapid Generation of Multiple Loci-Engineered Marker-free Poxvirus and Characterization of a Clinical-Grade Oncolytic Vaccinia Virus," Molecular Therapy: Methods & Clinical Development, 7:112-122.
Jacobs et al., 2009, "Vaccinia virus vaccines: past, present and future," Antiviral Research, 84(1):1-13.
Littaua et al., 1992, "Vaccinia virus-specific human CD4+ cytotoxic T-lymphocyte clones," Journal of Virology, 66(4)2274-2280.
Moss, 2013, "Poxvirus DNA replication," Cold Spring Harbor Perspectives in Biology, 5(9):1-12.
Perkus et al. 1989, "Cloning and expression of foreign genes in vaccinia vims, using a host range selection system," Journal of Virology, 63(9):3829-3836.
Smith et al., 1993, "Host range selection of vaccinia recombinants containing insertions of foreign genes into non-coding sequences," Vaccine, 11(1):43-53.
Symons et al., 1995, "Vaccinia virus encodes a soluble type I interferon receptor of novel structure and broad species specificity," Cell, 81(4):551-560.
Symons et al., 2002, "The vaccinia virus C12L protein inhibits mouse IL-18 and promotes virus virulence in the murine intranasal model," Journal of General Virology, 83(11):2833-2844.
Tartaglia et al., 1992, "NYVAC: A Highly Attenuated Strain of Vaccinia Virus," Elsevier, Amsterdam, NL, Virology 188(1): 217-232.
Yu et al., 2010, "One time intranasal vaccination with a modified vaccinia Tiantan strain MVTTzci protects animals against pathogenic viral challenge," Elsevier, Amsterdam, NL, Virology 28(9): 2088-2096.
Zhu et al., 2007, "The attenuation of vaccinia Tian Tan strain by the removal of the viral M1L-K2L genes," Journal of Virology Methods, 144(1-2):17-26.
Breitbach et al., 2015, "Pexa-Vec double agent engineered vaccinia: oncolytic and active immunotherapeutic," Current opinion in virology 13:49-54.
Cripe et al., 2015, "Phase 1 study of intratumoral Pexa-Vec (JX-594), an oncolytic and immunotherapeutic vaccinia virus, in pediatric cancer patients," Molecular therapy: the journal of the American Society of Gene Therapy, 23:602-608.
Heo et al., 2013, "Randomized dose-finding clinical trial of oncolytic immunotherapeutic vaccinia JX-594 in liver cancer," Nat Med, 19:329-336.
Hwang et al., 2011, "A mechanistic proof-of-concept clinical trial with JX-594, a targeted multi-mechanistic oncolytic poxvirus, in patients with metastatic melanoma," Molecular therapy: the journal of the American Society of Gene Therapy, 19:1913-1922.
Park et al., 2008, "Use of a targeted oncolytic poxvirus, JX-594, in patients with refractory primary or metastatic liver cancer: a phase I trial," Lancet Oncol, 9:533-542.
Park et al., 2015, "Phase 1b Trial of Biweekly Intravenous Pexa-Vec (JX-594), an Oncolytic and Immunotherapeutic Vaccinia Virus in Colorectal Cancer," Mol Ther 23:1532-1540.

(56) References Cited

OTHER PUBLICATIONS

Fischer et al., 2006, "Modified vaccinia virus Ankara protein F1L is a novel Bh3-domain-binding protein and acts together with the early viral protein E3L to block virus-associated apoptosis," 13:109-118.
Pelin, 2019, "Bio-Engineering Vaccinia Virues for Increased Oncolytic Potential", Available at https://ruor.uottawa.ca/handle/10393/39909 [retrieved on Jun. 28, 2022] (201 pages).
Sedova, et al., 2012, "Recombinant Influenza Vaccines," Acta Naturae, 4(4):17-27.

* cited by examiner (Fitness competition)

(Replication in patient tumor cores)

(Distribution of transposon knockouts)

(Major deletions)

(Cancer cell killing)

(Growth in Cancer cells)

(Growth in patient tumor samples)

(Plaque difference, synthecia)

(Synthecia)

(Tumor control and weight loss)

(Pox lesion formation)

(IVIS Bio-distribution of Vaccinia after systemic administration)

FIG. 17
CopMD5p3p
Cop TK-
Wyeth TK-
VVdd
LLD
Titer (pfu/organ)
$10^9$
$10^8$
$10^7$
$10^6$
$10^5$
$10^4$
$10^3$
$10^2$
Tumour
Tail
Spleen
Lungs
Ovaries
Liver
Brain
Organ

(Bio-distribution of Vaccinia after systemic administration (titer))

(Immunogenicity of Vaccinia in Human PBMCs)

(immunogenicity of Vaccinia in Mouse Splenocytes)

(immunogenicity of Vaccinia in Human cells )

(Synergy with immune checkpoint inhibitor Anti-CTLA-4 in an aggressive melanoma model)

(synergy with immune checkpoint inhibitor Anti-CTLA4)

(synergy with immune checkpoint inhibitors Anti-PD1 and Anti-CTLA-4)

FIG. 42

| Virus | Deletion | Syncytia | Cytotoxicity (HeLa) | Replication |
|---|---|---|---|---|
| Wyeth | NP | no | + | yes |
| Wyeth | 5p | yes | +++ | yes |
| Wyeth | 3p | no | + | yes |
| Wyeth | 5p3p | yes | +++ | yes |
| TianTan | NP | No | + | yes |
| TianTan | 5p | yes | +++ | yes |
| TianTan | 3p | no | + | yes |
| TianTan | 5p3p | yes | +++ | yes |
| Lister | NP | no | + | yes |
| Lister | 5p | yes | +++ | yes |
| Lister | 3p | no | + | yes |
| Lister | 5p3p | yes | +++ | yes |
| Western Reserve | NP | no | + | yes |
| Western Reserve | 5p | yes | +++ | yes |
| Western Reserve | 3p | ND | ND | ND |
| Western Reserve | 5p3p | ND | ND | ND |

NP: Wildtype virus with *no major deletions present*
ND: Not determined

FIG. 44

| Vaccinia strain | WR | Wyeth | Lister | TianTan |
|---|---|---|---|---|
| WT | ++ | +++ | +++ | +++ |
| 5p3p | ND | - | - | - |
| 5p | + | ND | ND | ND |

| | |
|---|---|
| - | no pox lesions |
| + | Tail only |
| ++ | Tail and paws |
| +++ | Tail, paws, and parts of Body |
| ND | Not determined |

MODIFIED ORTHOPOXVIRUS VECTORS

CROSS-REFERENCE TO RELATED APPLICATIONS

This application is a U.S. national stage of International Patent Application No. PCT/CA2019/050014, filed Jan. 4, 2019, which claims the benefit of U.S. Provisional Patent Application No. 62/784,371, filed Dec. 21, 2018 and U.S. Provisional Patent Application No. 62/614,349, filed Jan. 5, 2018, the disclosure of each of which is incorporated by reference herein in its entirety.

SEQUENCE LISTING

This application incorporates by reference in its entirety the Computer Readable Form of a Sequence Listing in ASCII text format submitted via EFS-Web. The Sequence Listing text file submitted via EFS-Web is entitled "14596-045-999_SEQ_LISTING.txt," was created on Jun. 28, 2020 and is 723,214 bytes in size.

FIELD

The invention relates to the field of immunotherapy, e.g., for the treatment of cell proliferation disorders, such as cancers. Particularly, the invention relates to genetically modified orthopoxviruses, as well as methods of making and using the same.

BACKGROUND

The immune system may be stimulated to identify tumor cells and target them for destruction. Immunotherapy employing oncolytic orthopoxviruses is a rapidly evolving area in cancer research. New approaches are needed to engineer and/or enhance tumor-selectivity for oncolytic viruses in order to maximize efficiency and safety. This selectivity is especially important when potentially toxic therapeutic agents or genes are added to the viruses.

Although the use of orthopoxviruses as clinical oncolytic vectors is a promising paradigm for cancer treatment, due to toxicity, such as pox lesions in patients, and immunosuppressive side effects, most current clinical candidates have shown only modest clinical success. There exists a need for methods to engineer orthopoxviruses that exhibit more robust virus replication, cancer cell killing, and spreading from the point of infection. The present invention addresses this need and provides a solution to selectivity and safety limitations by employing a modified vaccinia virus.

SUMMARY

The present disclosure describes the use of orthopoxviruses for the treatment of cancer. In particular, the disclosure is based in part on the surprisingly enhanced oncolytic activity, spread of infection, and safety results engendered when a orthopoxvirus is genetically modified to contain deletions in one or more, or all, of the following genes: C2L, C1L, N1 L, N2L, M1 L, M2L, K1 L, K2L, K3L, K4L, K5L, K6L, K7R, F1 L, F2L, F3L, B14R, B15R, B16R, B17L, B18R, B19R, B20R, K ORF A, K ORF B, B ORF E, B ORF F, B ORF G, B21R, B22R, B23R, B24R, B25R, B26R, B27R, B28R, and B29R. Genetically modified orthopoxviruses, such as vaccinia viruses (e.g., Copenhagen, Western Reserve, Wyeth, Lister, EM63, ACAM2000, CV-1, modified vaccinia Ankara (MVA), Dairen I, GLV-1h68, IHD-J, L-IVP, LC16m8, LC16mO, Tashkent, Tian Tan, and WAU86/88-1 viruses) that exhibit mutations in one or more, or all, of these genes may exhibit an array of beneficial features, such as improved oncolytic ability, replication in tumors, infectivity, immune evasion, tumor persistence, capacity for incorporation of exogenous DNA sequences, and/or amenability for large scale manufacturing. The present disclosure describes orthopox viruses further genetically modified to contain deletions in the B8R gene. In various embodiments disclosed below, the invention may or may not include a deletion of the B8R gene. In various embodiments, the modified orthopoxvirus expresses at least one of three transgenes: IL-12-TM, FLT3-L and anti-CTLA4 antibody.

In a first aspect, the invention features a nucleic acid that includes a recombinant orthopoxvirus genome, wherein the recombinant orthopoxvirus genome has a deletion of at least 2, 3, 4, 5, 6, 7, 8, 9, 10, 11, 12, 13, 14, 15, 16, 17, 18, 19, 20, 21 or 22 genes, each independently selected from the group consisting of C2L, C1L, N1L, N2L, ML, M2L, K1L, K2L, K3L, K4L, K5L, K6L, K7R, F1L, F2L, F3L, B14R, B15R, B16R, B17L, B18R, B19R, 820R. In some embodiments, the deletion includes each of C2L, C1L, N1L, N2L, M1L, M2L, K1L, K2L, K3L, K4L, K5L, K6L, K7R, F1L, F2L, F3L, B14R, B15R, B16R, B17L, B18R, B19R, B20R genes. In any one of the embodiments, disclosed herein, the recombinant orthopoxvirus genome may further include a deletion of the B8R gene.

In another aspect, the invention features a nucleic acid that includes a recombinant orthopoxvirus genome, wherein the recombinant orthopoxvirus genome has a deletion of at least 1 gene selected from the group consisting of B14R, B16R, B17L, B18R, B19R, and B20R. In some embodiments, the deletion includes at least 2, 3, 4, or 5 genes, each independently selected from the group consisting of B14R, B16R, B17L, B18R, B19R, and B20R. In some embodiments, the deletion includes each of B14R, B16R, B17L, B18R, B19R, and B20R. In any one of the embodiments, disclosed herein, the recombinant orthopoxvirus genome may further include a 88R deletion.

In another aspect, the invention features a nucleic acid that includes a recombinant orthopoxvirus genome, wherein the recombinant orthopoxvirus genome has a deletion of at least 1 gene selected from the group consisting of C2L, C1L, N1L, N2L, M1L, M2L, K1L, K2L, K3L, K4L, K5L, K6L, K7R, F1L, F2L, and F3L. In some embodiments, the deletion includes at least 2, 3, 4, 5, 6, 7, 8, 9, 10, 11, 12, 13, 14, or 15 genes, each independently selected from the group consisting of C2L, C1L, N1L, N2L, M1L, M2L, K1L, K2L, K3L, K4L, K5L, K6L, K7R, F1 L, F2L, and F3L. In some embodiments, the deletion includes each of C2L, C1L, N1L, N2L, M1L, M2L, K1L, K2L, K3L, K4L, K5L, K6L, K7R, F1L, F2L, and F3L. In any one of the embodiments, disclosed herein, the recombinant orthopoxvirus genome may further include a B8R deletion.

In another aspect, the invention features a nucleic acid that includes a recombinant orthopoxvirus genome, wherein the recombinant orthopoxvirus genome has a deletion of at least 1 gene that encodes a caspase-9 inhibitor.

In some embodiments, the recombinant orthopoxvirus genome has a deletion of at least 1 gene that encodes a caspase-9 inhibitor. In some embodiments, the gene that encodes a caspase-9 inhibitor is F1L.

In another aspect, the invention features a nucleic acid that includes a recombinant orthopoxvirus genome, wherein the recombinant orthopoxvirus genome has a deletion of at least 1 gene that encodes a BCL-2 inhibitor.

In some embodiments, the recombinant orthopoxvirus genome has a deletion of at least 1 gene that encodes a BCL-2 inhibitor. In some embodiments, the gene that encodes a BCL-2 inhibitor is N L.

In another aspect, the invention features a nucleic acid that includes a recombinant orthopoxvirus genome, wherein the recombinant orthopoxvirus genome has a deletion of at least 1 gene that encodes a dUTPase.

In some embodiments, the recombinant orthopoxvirus genome has a deletion of at least 1 gene that encodes a dUTPase. In some embodiments, the gene that encodes a dUTPase is F2L.

In another aspect, the invention features a nucleic acid that includes a recombinant orthopoxvirus genome, wherein the recombinant orthopoxvirus genome has a deletion of at least 1 gene that encodes a IFN-alpha/beta-receptor-like secreted glycoprotein.

In some embodiments, the recombinant orthopoxvirus genome has a deletion of at least 1 gene that encodes a IFN-alpha/beta-receptor-like secreted glycoprotein. In some embodiments, the gene that encodes a IFN-alpha/beta-receptor-like secreted glycoprotein is B19R.

In another aspect, the invention features a nucleic acid that includes a recombinant orthopoxvirus genome, wherein the recombinant orthopoxvirus genome has a deletion of at least 1 gene that encodes an IL-1-beta-inhibitor.

In some embodiments, the recombinant orthopoxvirus genome has a deletion of at least 1 gene that encodes an IL-1-beta-inhibitor. In some embodiments, the gene that encodes an IL-1-beta-inhibitor is B16R.

In another aspect, the invention features a nucleic acid that includes a recombinant orthopoxvirus genome, wherein the recombinant orthopoxvirus genome has a deletion of at least 1 gene that encodes a phospholipase-D.

In some embodiments, the recombinant orthopoxvirus genome has a deletion of at least 1 gene that encodes a phospholipase-D. In some embodiments, the gene that encodes a phospholipase-D is K4L.

In another aspect, the invention features a nucleic acid that includes a recombinant orthopoxvirus genome, wherein the recombinant orthopoxvirus genome has a deletion of at least 1 gene that encodes a PKR inhibitor.

In some embodiments, the recombinant orthopoxvirus genome has a deletion of at least 1 gene that encodes a PKR inhibitor. In some embodiments, the gene that encodes a PKR inhibitor is K3L.

In another aspect, the invention features a nucleic acid that includes a recombinant orthopoxvirus genome, wherein the recombinant orthopoxvirus genome has a deletion of at least 1 gene that encodes a serine protease inhibitor.

In some embodiments, the recombinant orthopoxvirus genome has a deletion of at least 1 gene that encodes a serine protease inhibitor. In some embodiments, the gene that encodes a serine protease inhibitor is K2L.

In another aspect, the invention features a nucleic acid that includes a recombinant orthopoxvirus genome, wherein the recombinant orthopoxvirus genome has a deletion of at least 1 gene that encodes a TLR signaling inhibitor. In some embodiments, the recombinant orthopoxvirus genome has a deletion of at least 1 gene that encodes a TLR signaling inhibitor. In some embodiments, the gene that encodes a TLR signaling inhibitor is N2L.

In another aspect, the invention features a nucleic acid that includes a recombinant orthopoxvirus genome, wherein the recombinant orthopoxvirus genome has a deletion of at least 1 gene that encodes a kelch-like protein. In some embodiments, the recombinant orthopoxvirus genome has a deletion of at least 1 gene that encodes a kelch-like protein. In some embodiments, the recombinant orthopoxvirus genome has a deletion of at least 2 genes that each encodes a kelch-like protein. In some embodiments, the genes that encode a kelch-like protein are, independently, selected from the group consisting of F3L and C2L.

In another aspect, the invention features a nucleic acid that includes a recombinant orthopoxvirus genome, wherein the recombinant orthopoxvirus genome has a deletion of at least 1 gene that encodes a monoglyceride lipase.

In some embodiments, the recombinant orthopoxvirus genome has a deletion of at least 1 or 2 genes that encodes a monoglyceride lipase. In some embodiments, the genes that encode a monoglyceride lipase are, independently, selected from the group consisting of K5L and K6L.

In another aspect, the invention features a nucleic acid that includes a recombinant orthopoxvirus genome, wherein the recombinant orthopoxvirus genome has a deletion of at least 1, 2 or 3 genes that encodes an NF-κB inhibitor. In some embodiments, the genes that encode an NF-κB inhibitor are, independently selected from the group consisting of K7R, K1L, and M2L.

In another aspect, the invention features a nucleic acid that includes a recombinant orthopoxvirus genome, wherein the recombinant orthopoxvirus genome has a deletion of at least 1, 2, or 3 genes that encodes an Ankyrin repeat protein. In some embodiments, the genes that encode an Ankyrin repeat protein are, independently, selected from the group consisting of B18R, B20R, and M1L.

In another aspect, the invention features a nucleic acid that includes a recombinant orthopoxvirus genome, wherein the recombinant orthopoxvirus genome has a deletion of at least 1, 2 or 3 genes each independently selected from the group consisting of B15R, B17L, and B14R.

In another aspect, the invention features a nucleic acid that includes a recombinant orthopoxvirus genome, wherein the recombinant orthopoxvirus genome has a deletion of at least 1, 2, 3, or 4, gene selected from the group consisting of K ORF A, K ORF B, B ORF E, B ORF F, and B ORF G. In any one of the embodiments, disclosed herein, the recombinant orthopoxvirus genome further includes a B8R deletion.

In some embodiments, the recombinant orthopoxvirus genome has a deletion of at least 1 gene selected from the group of inverted terminal repeat (ITR) genes consisting of B21R, B22R, B23R, B24R, B25R, B26R, B27R, B28R, and B29R. In some embodiments, the deletion includes at least 2, 3, 4, 5, 6, 7, or 8 genes, each independently selected from the group of ITR genes consisting of B21R, B22R, B23R, B24R, B25R, B26R, B27R, B28R, and B29R. In some embodiments, the deletion includes each of B21R, B22R, B23R, B24R, B25R, B26R, B27R, B28R, and B29R. In any one of the embodiments, disclosed herein, the recombinant orthopoxvirus genome may further include a B8R deletion.

In some embodiments, the vaccinia virus is a strain selected from the group consisting of Copenhagen, Western Reserve, Wyeth, Lister, EM63, ACAM2000, CV-1, modified vaccinia Ankara (MVA), Dairen I, GLV-1h68, IHD-J, L-IVP, LC16m8, LC16mO, Tashkent, Tian Tan, and WAU86/88-1 In some embodiments, the vaccinia virus is a strain selected from the group consisting of Copenhagen, Western Reserve, Tian Tan, Wyeth, and Lister. In some embodiments, the vaccinia virus is a Copenhagen strain vaccinia virus.

In some embodiments, one or more, or all, of the deletions is a deletion of the entire polynucleotide encoding the corresponding gene. In some embodiments, one or more, or all, of the deletions is a deletion of a portion of the polynucleotide encoding the corresponding gene, such that the deletion is sufficient to render the gene nonfunctional, e.g., upon introduction into a host cell.

In some embodiments, the nucleic acid further includes a transgene encoding a tumor-associated antigen. In some embodiments, the tumor-associated antigen is a tumor-associated antigen listed in any one of Tables 3-30 herein. In some embodiments, the tumor-associated antigen is a tumor-associated antigen selected from the group consisting of CD19, CD33, EpCAM, CEA, PSMA, EGFRvIII, CD133, EGFR, CDH19, ENPP3, DLL3, MSLN, ROR1, HER2, HLAA2, EpHA2, EpHA3, MCSP, CSPG4, NG2, RON, FLT3, BCMA, CD20, FAPα, FRα, CA-9, PDGFRα, PDGFRβ, FSP1, S100A4, ADAM12m, RET, MET, FGFR, INSR, and NTRK. In some embodiments, the tumor-associated antigen includes MAGE-A3, or one or more fragments thereof. In some embodiments, the tumor-associated antigen includes NY-ESO-1, or one or more fragments thereof. In some embodiments, the tumor-associated antigen includes one or mom human papillomavirus (HPV) proteins, or fragments thereof. In some embodiments, the tumor-associated antigen includes (i) E6 and E7 proteins, or fragments thereof, of HPV16 and (ii) E6 and E7 proteins, or fragments thereof, of HPV18. In some embodiments, the tumor-associated antigen includes brachyury or one or more fragments thereof. In some embodiments, the tumor-associated antigen includes prostatic acid phosphatase, or one or more fragments thereof.

In some embodiments, the nucleic acid further includes a transgene encoding an immune checkpoint inhibitor. In some embodiments, the immune checkpoint inhibitor is selected from the group consisting of OX40 ligand, ICOS ligand, anti-CD47 antibody or antigen-binding fragment thereof, anti-CD40/CD40L antibody or antigen-binding fragment thereof, anti-Lag3 antibody or antigen-binding fragment thereof, anti-CTLA-4 antibody or antigen-binding fragment thereof, anti-PD-L1 antibody or antigen-binding fragment thereof, anti-PD1 antibody or antigen-binding fragment thereof, and anti-Tim-3 antibody or antigen-binding fragment thereof. In some embodiments, the immune checkpoint inhibitor is an anti-PD1 antibody or antigen-binding fragment thereof or an anti-CTLA-4 antibody or antigen-binding fragment thereof. In some embodiments, the immune checkpoint inhibitor is an anti-PD1 antibody or antigen-binding fragment thereof. In some embodiments, the immune checkpoint inhibitor is an anti-CTLA-4 antibody or antigen-binding fragment thereof.

Antibodies or antigen-binding fragments thereof described herein may be full-length antibodies or antibody fragments, such as a monoclonal antibody or antigen-binding fragment thereof, a polyclonal antibody or antigen-binding fragment thereof, a humanized antibody or antigen-binding fragment thereof, a primatized antibody or antigen-binding fragment thereof, a bispecific antibody or antigen-binding fragment thereof, a multi-specific antibody or antigen-binding fragment thereof, a dual-variable immunoglobulin domain, a monovalent antibody or antigen-binding fragment thereof, a chimeric antibody or antigen-binding fragment thereof, a single-chain Fv molecule (scFv), a diabody, a triabody, a nanobody, an antibody-like protein scaffold, a domain antibody, a Fv fragment, a Fab fragment, a $F(ab')_2$ molecule, and a tandem scFv (taFv). In some embodiments, the antibody or antigen-binding fragment thereof contains two or more CDRs covalently bound to one another, e.g., by an amide bond, a thioether bond, a carbon-carbon bond, or a disulfide bridge, or by a linker, such as a linker described herein. In some embodiments, the antibody or antigen-binding fragment thereof is a single-chain polypeptide. In some embodiments, the antibody or antigen-binding fragment thereof has an isotype selected from the group consisting of IgG, IgA, IgM, IgD, and IgE.

In some embodiments, the nucleic acid further includes a transgene encoding an interleukin. In some embodiments, the interleukin (IL) is selected from the group consisting of IL-1 alpha, IL-1 beta, IL-2, IL-4, IL-7, IL-10, IL-12 p35, IL-12 p40, IL-12 p70, IL-15, IL-18, IL-21, and IL-23. In some embodiments, the interleukin is selected from the group consisting of IL-12 p35, IL-12 p40, and IL-12 p70. In some embodiments, the interleukin is membrane-bound.

In some embodiments, the nucleic acid further includes a transgene encoding an interferon. In some embodiments, the interferon is selected from the group consisting of IFN-alpha, IFN-beta, IFN-delta, IFN-epsilon, IFN-tau, IFN-omega, IFN-zeta, and IFN-gamma.

In some embodiments, the nucleic acid further includes a transgene encoding a TNF superfamily member protein. In some embodiments, the TNF superfamily member protein is selected from the group consisting of TRAIL, Fas ligand, LIGHT (TNFSF-14), TNF-alpha, and 4-1BB ligand.

In some embodiments, the nucleic acid further includes a transgene encoding a cytokine. In some embodiments, the cytokine selected from the group consisting of GM-CSF, FMS-like tyrosine kinase 3 ligand (Flt3 ligand), CD40 ligand, anti-TGF-beta, anti-VEGF-R2, and guanyl adenylate cyclase (cGAS). In some embodiments, the cytokine is Flt3 ligand.

In another aspect, the invention features a recombinant orthopoxvirus vector that has a deletion of at least 2, 3, 4, 5, 6, 7, 8, 9, 10, 11, 12, 13, 14, 15, 16, 17, 18, 19, 20, 21 or 22 genes, each independently selected from the group consisting of C2L, C1L, N1L, N2L, M1L, M2L, K1L, K2L, K3L, K4L, K5L, K6L, K7R, F1L, F2L, F3L, B14R, B15R, B16R, B17L, B18R, B19R, B20R. In some embodiments, the deletion includes each of C2L, C1L, N1L, N2L, M1L, M2L, K1L, K2L, K3L, K4L, K5L, K6L, K7R, F1L, F2L, F3L, B14R, B15R, B16R, B17L, B18R, B19R, and B20R. In anyone of the embodiments, disclosed herein, the recombinant orthopoxvirus genome may further include a B8R deletion.

In another aspect, the invention features a recombinant orthopoxvirus vector that includes a recombinant orthopoxvirus genome, wherein the recombinant orthopoxvirus genome has a deletion of at least 1 gene selected from the group consisting of B14R, B16R, B17L, B18R, B19R, and B20R. In some embodiments, the deletion includes at least 2, 3, 4, or 5 genes, each independently selected from the group consisting of B14R, B16R, B17L, B18R, B19R, and B20R. In some embodiments, the deletion includes each of B14R, B16R, B17L, B18R, B19R, and B20R. In anyone of the embodiments, disclosed herein, the recombinant orthopoxvirus genome may further include a B8R deletion.

In another aspect, the invention features a recombinant orthopoxvirus vector that includes a recombinant orthopoxvirus genome, wherein the recombinant orthopoxvirus genome has a deletion of at least 1 gene selected from the group consisting of C2L, C1L, N1L, N2L, M1L, M2L, K1L, K2L, K3L, K4L, K5L, K6L, K7R, F1L, F2L, and F3L. In anyone of the embodiments, disclosed herein, the recombinant orthopoxvirus genome may further include a B8R deletion.

In some embodiments, the recombinant orthopoxvirus vector has a deletion of at least 1 gene selected from the group consisting of C2L, C1L, N1L, N2L, M1L, K1L, K2L, K3L, K4L, K7R, and F2L. In some embodiments, the deletion includes at least 2, 3, 4, 5, 6, 7, 8, 9, 10, 11, 12, 13, 14, 15, or 16 genes, each independently selected from the group consisting of C2L, C1L, N1L, N2L, M1L, M2L, K1L, K2L, K3L, K4L, K5L, K6L, K7R, F1L, F2L, and F3L. In some embodiments, the deletion includes each of C2L, C1L, N1L, N2L, M1L, M2L, K1L, K2L, K3L, K4L, K5L, K6L, K7R, F1L, F2L, and F3L. In any one of the embodiments, disclosed herein, the recombinant orthopoxvirus genome may further include a B8R deletion.

In another aspect, the invention features a recombinant orthopoxvirus vector that has a deletion of at least 1 gene that encodes a caspase-9 inhibitor.

In some embodiments, the recombinant orthopoxvirus genome has a deletion of at least 1 gene that encodes a caspase-9 inhibitor. In some embodiments, the gene that encodes a caspase-9 inhibitor is F1L.

In another aspect, the invention features a recombinant orthopoxvirus vector has a deletion of at least 1 gene that encodes a BCL-2 inhibitor.

In some embodiments, the recombinant orthopoxvirus genome has a deletion of at least 1 gene that encodes a BCL-2 inhibitor. In some embodiments, the gene that encodes a BCL-2 inhibitor is N1L.

In another aspect, the invention features a recombinant orthopoxvirus vector has a deletion of at least 1 gene that encodes a dUTPase.

In some embodiments, the recombinant orthopoxvirus genome has a deletion of at least 1 gene that encodes a dUTPase. In some embodiments, the gene that encodes a dUTPase is F2L.

In another aspect, the invention features a recombinant orthopoxvirus vector has a deletion of at least 1 gene that encodes a IFN-alpha/beta-receptor-like secreted glycoprotein.

In some embodiments, the recombinant orthopoxvirus genome has a deletion of at least 1 gene that encodes a IFN-alpha/beta-receptor-like secreted glycoprotein. In some embodiments, the gene that encodes a IFN-alpha/beta-receptor-like secreted glycoprotein is B19R.

In another aspect, the invention features a recombinant orthopoxvirus vector has a deletion of at least 1 gene that encodes an IL-1-beta-inhibitor.

In some embodiments, the recombinant orthopoxvirus genome has a deletion of at least 1 gene that encodes an IL-1-beta-inhibitor. In some embodiments, the gene that encodes an IL-1-beta-inhibitor is B16R.

In another aspect, the invention features a recombinant orthopoxvirus vector has a deletion of at least 1 gene that encodes a phospholipase-D.

In some embodiments, the recombinant orthopoxvirus genome has a deletion of at least 1 gene that encodes a phospholipase-D. In some embodiments, the gene that encodes a phospholipase-D is K4L.

In another aspect, the invention features a recombinant orthopoxvirus vector has a deletion of at least 1 gene that encodes a PKR inhibitor.

In some embodiments, the recombinant orthopoxvirus genome has a deletion of at least 1 gene that encodes a PKR inhibitor. In some embodiments, the gene that encodes a PKR inhibitor is K3L.

In another aspect, the invention features a recombinant orthopoxvirus vector has a deletion of at least 1 gene that encodes a serine protease inhibitor.

In some embodiments, the recombinant orthopoxvirus genome has a deletion of at least 1 gene that encodes a serine protease inhibitor. In some embodiments, the gene that encodes a serine protease inhibitor is K2L.

In another aspect, the invention features a recombinant orthopoxvirus vector has a deletion of at least 1 gene that encodes a TLR signaling inhibitor.

In some embodiments, the recombinant orthopoxvirus genome has a deletion of at least 1 gene that encodes a TLR signaling inhibitor. In some embodiments, the gene that encodes a TLR signaling inhibitor is N2L.

In another aspect, the invention features a recombinant orthopoxvirus vector has a deletion of at least 1 gene that encodes a kelch-like protein.

In some embodiments, the recombinant orthopoxvirus genome has a deletion of at least 1 or 2 genes that encodes a kelch-like protein. In some embodiments, the genes that encode a kelch-like protein are, independently, selected from the group consisting of F3L and C2L.

In another aspect, the invention features a recombinant orthopoxvirus vector has a deletion of at least 1 gene that encodes a monoglyceride lipase.

In some embodiments, the recombinant orthopoxvirus genome has a deletion of at least 1 gene that encodes a monoglyceride lipase. In some embodiments, the recombinant orthopoxvirus genome has a deletion of at least 2 genes that each encodes a monoglyceride lipase. In some embodiments, the genes that encode a monoglyceride lipase are, independently, selected from the group consisting of K5L and K6L.

In another aspect, the invention features a recombinant orthopoxvirus vector has a deletion of at least 1 gene that encodes an NF-κB inhibitor.

In some embodiments, the recombinant orthopoxvirus genome has a deletion of at least 1, 2, or 3 genes that encodes an NF-κB inhibitor. In some embodiments, the genes that encode an NF-κB inhibitor are, independently, selected from the group consisting of K7R, K1L, and M2L.

In another aspect, the invention features a recombinant orthopoxvirus vector has a deletion of at least 1 gene that encodes an Ankyrin repeat protein.

In some embodiments, the recombinant orthopoxvirus genome has a deletion of at least 1 gene that encodes an Ankyrin repeat protein. In some embodiments, the recombinant orthopoxvirus genome has a deletion of at least 2 genes that each encodes an Ankyrin repeat protein. In some embodiments, the recombinant orthopoxvirus genome has a deletion of at least 3 genes that each encodes an Ankyrin repeat protein. In some embodiments, the genes that encode an Ankyrin repeat protein are, independently, selected from the group consisting of B18R, B20R, and M1L.

In another aspect, the invention features a recombinant orthopoxvirus vector has a deletion of at least 1 gene selected from the group consisting of B15R, B17L, and B14R.

In some embodiments, the recombinant orthopoxvirus genome has a deletion of at least 1 gene selected from the group consisting of B15R, B17L, and B14R. In some embodiments, the recombinant orthopoxvirus genome has a deletion of at least 2 genes selected from the group consisting of B15R, B17L, and B14R. In some embodiments, the recombinant orthopoxvirus genome has a deletion of at least 3 genes selected from the group consisting of B15R, B17L, and B14R. In any one of the embodiments, disclosed herein, the recombinant orthopoxvirus genome may further include a B8R deletion.

In another aspect, the invention features a recombinant orthopoxvirus vector that includes a recombinant orthopoxvirus genome, wherein the recombinant orthopoxvirus genome has a deletion of at least 1 gene selected from the group consisting of K ORF A, K ORF B, B ORF E, B ORF F, and B ORF G.

In some embodiments, the recombinant orthopoxvirus vector has a deletion of at least 1 gene selected from the group consisting of K ORF A, K ORF B, B ORF E, B ORF F, and B ORF G. In some embodiments, the vector has a deletion of at least 2, 3, or 4 genes selected from the group consisting of K ORF A, K ORF B, B ORF E, B ORF F, and B ORF G. In some embodiments, the deletion includes each of K ORF A, K ORF B, B ORF E, B ORF F, and B ORF G. In any one of the embodiments, disclosed herein, the recombinant orthopoxvirus genome may further include a B8R deletion.

In some embodiments, the recombinant orthopoxvirus vector has a deletion of at least 1 gene selected from the group of ITR genes consisting of B21R, B22R, B23R, B24R, B25R, B26R, B27R, B28R, and B29R. In some embodiments, the deletion includes at least 2, 3, 4, 5, 6, 7 or 8 genes, each independently selected from the group of ITR genes consisting of B21R, B22R, B23R, B24R, B25R, B26R, B27R, 1B28R, and B29R. In some embodiments, the deletion includes each of B21R, B22R, B23R, B24R, B25R, B26R, B27R, B28R, and B29L In anyone of the embodiments, disclosed herein, the recombinant orthopoxvirus genome may further include a B8R deletion.

In some embodiments, the orthopoxvirus is a vaccinia virus.

In some embodiments, the vaccinia virus is a strain selected from the group consisting of Copenhagen, Western Reserve, Wyeth, Lister, EM63, ACAM2000, CV-1, modified vaccinia Ankara (MVA), Dairen I, GLV-1h68, IHD-J, L-IVP, LC16m8, LC16mO, Tashkent, Tian Tan, and WAU86/88-1. In some embodiments, the vaccinia virus is a strain selected from the group consisting of Copenhagen, Western Reserve, Tian Tan, Wyeth, and Lister. In some embodiments, the vaccinia virus is a Copenhagen strain vaccinia virus.

In some embodiments, one or more, or all, of the deletions is a deletion of the entire polynucleotide encoding the corresponding gene. In some embodiments, one or more, or all, of the deletions is a deletion of a portion of the polynucleotide encoding the corresponding gene, such that the deletion is sufficient to render the gene nonfunctional, e.g., upon introduction into a host cell.

In some embodiments, the vector further includes a transgene encoding a tumor-associated antigen. In some embodiments, the tumor-associated antigen is a tumor-associated antigen listed in any one of Tables 3-30 herein. In some embodiments, the tumor-associated antigen is a tumor-associated antigen selected from the group consisting of CD19, CD33, EpCAM, CEA, PSMA, EGFRvIII, CD133, EGFR, CDH19, ENPP3, DLL3, MSLN, ROR1, HER2, HLAA2, EpHA2, EpHA3, MCSP, CSPG4, NG2, RON, FLT3, BCMA, CD20, FAPα, FRα, CA-9, PDGFRα, PDGFRβ, FSP1, S100A4, ADAM12m, RET, MET, FGFR, INSR, and NTRK. In some embodiments, the tumor-associated antigen includes MAGE-A3, or one or more fragments thereof. In some embodiments, the tumor-associated antigen includes NY-ESO-1, or one or more fragments thereof. In some embodiments, the tumor-associated antigen includes one or more human papillomavirus (HPV) proteins, or fragments thereof. In some embodiments, the tumor-associated antigen includes (i) E6 and E7 proteins, or fragments thereof, of HPV16 and (ii) E6 and E7 proteins, or fragments thereof, of HPV18. In some embodiments, the tumor-associated antigen includes brachyury or one or more fragments thereof. In some embodiments, the tumor-associated antigen includes prostatic acid phosphatase, or one or more fragments thereof.

In some embodiments, the vector further includes a transgene encoding an immune checkpoint inhibitor. In some embodiments, the immune checkpoint inhibitor is selected from the group consisting of OX40 ligand, ICOS ligand, anti-CD47 antibody or antigen-binding fragment thereof, anti-CD40/CD40L antibody or antigen-binding fragment thereof, anti-Lag3 antibody or antigen-binding fragment thereof, anti-CTLA-4 antibody or antigen-binding fragment thereof, anti-PD-L1 antibody or antigen-binding fragment thereof, anti-PD1 antibody or antigen-binding fragment thereof, and anti-Tim-3 antibody or antigen-binding fragment thereof. In some embodiments, the immune checkpoint inhibitor is an anti-PD1 antibody or antigen-binding fragment thereof or an anti-CTLA-4 antibody or antigen-binding fragment thereof. In some embodiments, the immune checkpoint inhibitor is an anti-PD1 antibody or antigen-binding fragment thereof. In some embodiments, the immune checkpoint inhibitor is an anti-CTLA-4 antibody or antigen-binding fragment thereof.

As described above, antibodies or antigen-binding fragments thereof described herein may be full-length antibodies or antibody fragments, such as a monoclonal antibody or antigen-binding fragment thereof, a polyclonal antibody or antigen-binding fragment thereof, a humanized antibody or antigen-binding fragment thereof, a primatized antibody or antigen-binding fragment thereof, a bispecific antibody or antigen-binding fragment thereof, a multi-specific antibody or antigen-binding fragment thereof, a dual-variable immunoglobulin domain, a monovalent antibody or antigen-binding fragment thereof, a chimeric antibody or antigen-binding fragment thereof, a single-chain Fv molecule (scFv), a diabody, a triabody, a nanobody, an antibody-like protein scaffold, a domain antibody, a Fv fragment, a Fab fragment, a $F(ab')_2$ molecule, and a tandem scFv (taFv). In some embodiments, the antibody or antigen-binding fragment thereof contains two or more CDRs covalently bound to one another, e.g., by an amide bond, a thioether bond, a carbon-carbon bond, or a disulfide bridge, or by a linker, such as a linker described herein. In some embodiments, the antibody or antigen-binding fragment thereof is a single-chain polypeptide. In some embodiments, the antibody or antigen-binding fragment thereof has an isotype selected from the group consisting of IgG, IgA, IgM, IgD, and IgE.

In some embodiments, the vector further includes a transgene encoding an interleukin. In some embodiments, the interleukin (IL) is selected from the group consisting of IL-1 alpha, IL-1 beta, IL-2, IL-4, IL-7, IL-10, IL-12 p35, IL-12 p40, IL-12 p70, IL-15, IL-18, IL-21, and IL-23. In some embodiments, the interleukin is selected from the group consisting of IL-12 p35, IL-12 p40, and IL-12 p70. In some embodiments, the interleukin is membrane-bound.

In some embodiments, the vector further includes a transgene encoding an interferon. In some embodiments, the interferon is selected from the group consisting of IFN-alpha, IFN-beta, IFN-delta, IFN-epsilon, IFN-tau, IFN-omega, IFN-zeta, and IFN-gamma.

In some embodiments, the vector further includes a transgene encoding a TNF superfamily member protein. In some embodiments, the TNF superfamily member protein is selected from the group consisting of TRAIL, Fas ligand, LIGHT (TNFSF-14), TNF-alpha, and 4-1BB ligand.

In some embodiments, the vector further includes a transgene encoding a cytokine. In some embodiments, the cytokine selected from the group consisting of GM-CSF, FMS-like tyrosine kinase 3 ligand (Flt3 ligand), CD40 ligand, anti-TGF-beta, anti-VEGF-R2, and guanyl adenylate cyclase (cGAS). In some embodiments, the cytokine is Flt3 ligand.

In some embodiments, upon contacting a population of mammalian cells (e.g., human cells, such as human cancer cells) with the nucleic acid or the recombinant orthopoxvirus vector, the cells exhibit increased syncytia formation relative to a population of mammalian cells of the same type contacted with a form of the orthopoxvirus vector that does not include the deletions, as assessed, for instance, by visual inspection using microscopy techniques described herein or known in the art.

In some embodiments, upon contacting a population of mammalian cells (e.g., human cells, such as human cancer cells) with the nucleic acid or the recombinant orthopoxvirus vector, the cells exhibit increased spreading of the orthopoxvirus vector relative to a population of mammalian cells of the same type contacted with a form of the orthopoxvirus vector that does not include the deletions, as assessed, for instance, using plaque-forming assays described herein or known in the art.

In some embodiments, the nucleic acid or the recombinant orthopoxvirus vector exerts an increased cytotoxic effect on a population of mammalian cells (e.g., human cells, such as human cancer cells) relative to that of a form of the orthopoxvirus vector that does not include the deletions, as assessed, for instance, using cell death assays descried herein or known in the art.

In some embodiments, the mammalian cells are from a cell line selected from the group consisting of U2OS, 293, 293T, Vero, HeLa, A549, BHK, BSC40, CHO, OVCAR-8, 786-0, NCI-H23, U251, SF-295, T-47D, SKMEL2, BT-549, SK-MEL-28, MDA-MB-231, SK-OV-3, MCF7, M14, SF-268, CAKI-1, HPAV, OVCAR-4, HCT15, K-562, and HCT-116.

In another aspect, the invention features a packaging cell line that contains the nucleic acid or the recombinant orthopoxvirus vector of any of the aspects or embodiments described herein.

In another aspect, the invention features a method of treating cancer in a mammalian patient by administering a therapeutically effective amount of the nucleic acid or the recombinant orthopoxvirus vector to the patient.

In some embodiments, the mammalian patient is a human patient.

In some embodiments, the cancer is selected from the group consisting of leukemia, lymphoma, liver cancer, bone cancer, lung cancer, brain cancer, bladder cancer, gastrointestinal cancer, breast cancer, cardiac cancer, cervical cancer, uterine cancer, head and neck cancer, gallbladder cancer, laryngeal cancer, lip and oral cavity cancer, ocular cancer, melanoma, pancreatic cancer, prostate cancer, colorectal cancer, testicular cancer, and throat cancer.

In some embodiments, the cancer is selected from the group consisting of acute lymphoblastic leukemia (ALL), acute myeloid leukemia (AML), chronic lymphocytic leukemia (CLL), chronic myelogenous leukemia (CML), adrenocortical carcinoma, AIDS-related lymphoma, primary CNS lymphoma, anal cancer, appendix cancer, astrocytoma, atypical teratoid/rhabdoid tumor, basal cell carcinoma, bile duct cancer, extrahepatic cancer, ewing sarcoma family, osteosarcoma and malignant fibrous histiocytoma, central nervous system embryonal tumors, central nervous system germ cell tumors, craniopharyngioma, ependymoma, bronchial tumors, burkitt lymphoma, carcinoid tumor, primary lymphoma, chordoma, chronic myeloproliferative neoplasms, colon cancer, extrahepatic bile duct cancer, ductal carcinoma in situ (DCIS), endometrial cancer, ependymoma, esophageal cancer, esthesioneuroblastoma, extracranial germ cell tumor, extragonadal germ cell tumor, fallopian tube cancer, fibrous histiocytoma of bone, gastrointestinal carcinoid tumor, gastrointestinal stromal tumors (GIST), testicular germ cell tumor, gestational trophoblastic disease, glioma, childhood brain stem glioma, hairy cell leukemia, hepatocellular cancer, langerhans cell histiocytosis, hodgkin lymphoma, hypopharyngeal cancer, islet cell tumors, pancreatic neuroendocrine tumors, wilms tumor and other childhood kidney tumors, langerhans cell histiocytosis, small cell lung cancer, cutaneous T cell lymphoma, intraocular melanoma, merkel cell carcinoma, mesothelioma, metastatic squamous neck cancer, midline tract carcinoma, multiple endocrine neoplasia syndromes, multiple myeloma/plasma cell neoplasm, myelodysplastic syndromes, nasal cavity and paranasal sinus cancer, nasopharyngeal cancer, neuroblastoma, non-hodgkin lymphoma (NHL), non-small cell lung cancer (NSCLC), epithelial ovarian cancer, germ cell ovarian cancer, low malignant potential ovarian cancer, pancreatic neuroendocrine tumors, papillomatosis, paraganglioma, paranasal sinus and nasal cavity cancer, parathyroid cancer, penile cancer, pharyngeal cancer, pheochromocytoma, pituitary tumor, pleuropulmonary blastoma, primary peritoneal cancer, rectal cancer, retinoblastoma, rhabdomyosarcoma, salivary gland cancer, kaposi sarcoma, rhabdomyosarcoma, sézary syndrome, small intestine cancer, soft tissue sarcoma, throat cancer, thymoma and thymic carcinoma, thyroid cancer, transitional cell cancer of the renal pelvis and ureter, urethral cancer, endometrial uterine cancer, uterine sarcoma, vaginal cancer, vulvar cancer, and Waldenström macroglobulinemia.

In some embodiments, the method further includes administering to the patient an immune checkpoint inhibitor. In some embodiments, the immune checkpoint inhibitor is selected from a group consisting of OX40 ligand, ICOS ligand, anti-CD47 antibody or antigen-binding fragment thereof, anti-CD40/CD40L antibody or antigen-binding fragment thereof, anti-Lag3 antibody or antigen-binding fragment thereof, anti-CTLA-4 antibody or antigen-binding fragment thereof, anti-PD-L1 antibody or antigen-binding fragment thereof, anti-PD1 antibody or antigen-binding fragment thereof, and anti-Tim-3 antibody or antigen-binding fragment thereof In some embodiments, the immune checkpoint inhibitor is an anti-PD1 antibody or antigen-binding fragment thereof or an anti-CTLA-4 antibody or antigen-binding fragment thereof. In some embodiments, the immune checkpoint inhibitor is an anti-PD1 antibody or antigen-binding fragment thereof. In some embodiments, the immune checkpoint inhibitor is an anti-CTLA-4 antibody or antigen-binding fragment thereof.

In some embodiments, the method further includes administering to the patient an interleukin. In some embodiments, the interleukin is selected from a group consisting of IL-alpha, IL-beta, IL-2, IL-4, IL-7, IL-10, IL-12 p35, IL-12 p40, IL-12 p70, IL-15, IL-18, IL-21, and IL-23. In some embodiments, the interleukin is selected from a group consisting of IL-12 p35, IL-12 p40, and IL-12 p70. In some embodiments, the interleukin is membrane-bound.

In some embodiments, the method further includes administering to the patient an interferon. In some embodiments, the interferon is selected from a group consisting of IFN-alpha, IFN-beta, IFN-delta, IFN-epsilon, IFN-tau, IFN-omega, IFN-zeta, and IFN-gamma.

In some embodiments, the method further includes administering to the patient a TNF superfamily member protein. In some embodiments, the TNF superfamily member protein is selected from a group consisting of TRAIL, Fas ligand, LIGHT (TNFSF-14), TNF-alpha, and 4-1BB ligand.

In some embodiments, the method further includes administering to the patient a cytokine. In some embodiments, the cytokine is selected from a group consisting of GM-CSF, Flt3 ligand, CD40 ligand, anti-TGF-beta, anti-VEGF-R2, and cGAS (guanyl adenylate cyclase).

In another aspect, the invention features a kit containing the nucleic acid or vector of any of the aspects or embodiments described herein and a package insert instructing a user of the kit to express the nucleic acid or vector in a host cell.

In another aspect, the invention features a kit containing the nucleic acid or recombinant orthopoxvirus vector of any of the aspects or embodiments described herein and a package insert instructing a user to administer a therapeutically effective amount of the nucleic acid or recombinant orthopoxvirus vector to a mammalian patient (e.g., a human patient) having cancer, thereby treating the cancer.

Definitions

As used herein, the term "about" refers to a value that is no more than 10% above or below the value being described. For example, the term "about 5 nM" indicates a range of from 4.5 nM to 5.5 nM.

As used herein, the term "antibody" (Ab) refers to an immunoglobulin molecule that specifically binds to, or is immunologically reactive with, a particular antigen, and includes polyclonal, monoclonal, genetically engineered and otherwise modified forms of antibodies, including but not limited to chimeric antibodies, humanized antibodies, heteroconjugate antibodies (e.g., bi- tri- and quad-specific antibodies, diabodies, triabodies, and tetrabodies), and antigen-binding fragments of antibodies, including e.g., Fab', F(ab')2, Fab, Fv, rlgG, and scFv fragments. Moreover, unless otherwise indicated, the term "monoclonal antibody" (mAb) is meant to include both intact molecules, as well as, antibody fragments (such as, for example, Fab and F(ab')2 fragments) that are capable of specifically binding to a target protein. Fab and F(ab')2 fragments lack the Fe fragment of an intact antibody, clear more rapidly from the circulation of the animal, and may have less non-specific tissue binding than an intact antibody (see Wahl et al., J. Nucl. Med. 24:316, 1 983; incorporated herein by reference).

The term "antigen-binding fragment," as used herein, refers to one or more fragments of an antibody that retain the ability to specifically bind to a target antigen. The antigen-binding function of an antibody can be performed by fragments of a full-length antibody. The antibody fragments can be a Fab, F(ab')2, scFv, SMIP, diabody, a triabody, an affibody, a nanobody, an aptamer, or a domain antibody. Examples of binding fragments encompassed of the term "antigen-binding fragment" of an antibody include, but are not limited to: (i) a Fab fragment, a monovalent fragment consisting of the VL, VH, CL, and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb including VH and VL domains; (vi) a dAb fragment (Ward et al., Nature 341:544-546, 1 989), which consists of a VH domain; (vii) a dAb which consists of a VH or a VL domain; (viii) an isolated complementarity determining region (CDR); and (ix) a combination of two or more isolated CDRs which may optionally be joined by a synthetic linker. Furthermore, although the two domains of the Fv fragment, VL and VH, are coded for by separate genes, they can be joined, using recombinant methods, by a linker that enables them to be made as a single protein chain in which the VL and VH regions pair to form monovalent molecules (known as single-chain Fv (scFv); see, e.g., Bird et al., Science 242:423-426, 1988, and Huston et al., Proc. Natl. Acad. Sci. USA 85:5879-5883, 1988). These antibody fragments can be obtained using conventional techniques known to those of skill in the art, and the fragments can be screened for utility in the same manner as intact antibodies. Antigen-binding fragments can be produced by recombinant DNA techniques, enzymatic or chemical cleavage of intact immunoglobulins, or, in some embodiments, by chemical peptide synthesis procedures known in the art.

As used herein, the term "bispecific antibodies" refers to monoclonal, often human or humanized antibodies that have binding specificities for at least two different antigens.

As used herein, the terms "cell," "cell line," and "cell culture" may be used interchangeably. All of these terms also include their progeny, which is any and all subsequent generations. It is understood that all progeny may not be identical due to deliberate or inadvertent mutations.

As used herein, the term "chimeric" antibody refers to an antibody having variable sequences derived from an immunoglobulin of one source organism, such as rat or mouse, and constant regions derived from an immunoglobulin of a different organism (e.g., a human). Methods for producing chimeric antibodies are known in the art. See, e.g., Morrison, 1985, Science 229(4719): 1202-7; Oi et al., 1986, BioTechniques 4:214-221; Gillies et al., 1985, J. Immunol. Methods 125:191-202; U.S. Pat. Nos. 5,807,715; 4,816,567; and 4,816,397; incorporated herein by reference.

As used herein, the term "complementarity determining region" (CDR) refers to a hypervariable region found both in the light chain and the heavy chain variable domains. The more highly conserved portions of variable domains are called the framework regions (FRs). As is appreciated in the art, the amino acid positions that delineate a hypervariable region of an antibody can vary, depending on the context and the various definitions known in the art. Some positions within a variable domain may be viewed as hybrid hypervariable positions in that these positions can be deemed to be within a hypervariable region under one set of criteria while being deemed to be outside a hypervariable region under a different set of criteria. One or more of these positions can also be found in extended hypervariable regions. The variable domains of native heavy and light chains each comprise four framework regions that primarily adopt a β-sheet configuration, connected by three CDRs, which form loops that connect, and in some cases form part of, the β-sheet structure. The CDRs in each chain are held together in close proximity by the FR regions in the order FR1-CDR1-FR2-CDR2-FR3-CDR3-FR4 and, with the CDRs from the other antibody chains, contribute to the formation of the target binding site of antibodies (see Kabat et al., Sequences of Proteins of Immunological Interest (National Institute of Health, Bethesda, Md. 1987; incorporated herein by reference).

As used herein, numbering of immunoglobulin amino acid residues is done according to the immunoglobulin amino acid residue numbering system of Kabat et al, unless otherwise indicated.

As used herein, the terms "conservative mutation," "conservative substitution," or "conservative amino acid substitution" refer to a substitution of one or more amino acids for one or more different amino acids that exhibit similar physicochemical properties, such as polarity, electrostatic charge, and steric volume. These properties are summarized for each of the twenty naturally-occurring amino acids in table 1 below. From this table it is appreciated that the conservative amino acid families include (i) G, A, V, L and I; (ii) D and E; (iii) C, Sand T; (iv) H, K and R; (v) N and Q; and (vi) F, Y and W. A conservative mutation or substitution is therefore one that substitutes one amino acid for a member of the same amino acid family (e.g., a substitution of Ser for Thr or Lys for Arg).

TABLE 1

Representative physicochemical properties of naturally occurring amino acids

| Amino Acid | 3 Letter Code | 1 Letter Code | Side-chain Polarity | Electrostatic character at physiological pH (7.4) | Steric Volume† |
|---|---|---|---|---|---|
| Alanine | Ala | A | nonpolar | neutral | small |
| Arginine | Arg | R | polar | cationic | large |
| Asparagine | Asn | N | polar | neutral | intermediate |
| Aspartic acid | Asp | D | polar | anionic | intermediate |
| Cysteine | Cys | C | nonpolar | neutral | intermediate |
| Glutamic acid | Glu | E | polar | anionic | intermediate |
| Glutamine | Gln | Q | polar | neutral | intermediate |
| Glycine | Gly | G | nonpolar | neutral | small |
| Histidine | His | H | polar | Both neutral and cationic forms in equilibrium at pH 7.4 | large |
| Isoleucine | Ile | I | nonpolar | neutral | large |
| Leucine | Leu | L | nonpolar | neutral | large |
| Lysine | Lys | K | polar | cationic | large |
| Methionine | Met | M | nonpolar | neutral | large |
| Phenylalanine | Phe | F | nonpolar | neutral | large |
| Proline | Pro | P | non-polar | neutral | intermediate |
| Serine | Ser | S | polar | neutral | small |
| Threonine | Thr | T | polar | neutral | intermediate |
| Tryptophan | Trp | W | nonpolar | neutral | bulky |
| Tyrosine | Tyr | Y | polar | neutral | large |
| Valine | Val | V | nonpolar | neutral | intermediate |

†based on volume in $A^3$: 50-100 is small, 100-150 is intermediate, 150-200 is large, and >200 is bulky As used herein, the terms "delete," "deletion," and the like refer to modifications to a gene or a regulatory element associated therewith or operatively linked thereto (e.g., a transcription factor-binding site, such as a promoter or enhancer element) that remove the gene or otherwise render the gene nonfunctional. Exemplary deletions, as described herein, include the removal of the entirety of a nucleic acid encoding a gene of interest, from the start codon to the stop codon of the target gene. Other examples of deletions as described herein include the removal of a portion of the nucleic acid encoding the target gene (e.g., one or more codon, or a portion thereof, such as a single nucleotide deletion) such that, upon expression of the partially-deleted target gene, the product is nonfunctional or less functional then a wild-type form of the target gene. Exemplary deletions as described herein include the removal of all or a portion of the regulatory element(s) associated with a gene of interest, such as all or a portion of the promoter and/or enhancer nucleic acids that regulate expression of the target gene.

As used herein, the term "derivatized antibodies" refers to antibodies that are modified by a chemical reaction so as to cleave residues or add chemical moieties not native to an isolated antibody. Derivatized antibodies can be obtained by glycosylation, acetylation, pegylation, phosphorylation, amidation, derivatization by addition of known chemical protecting/blocking groups, proteolytic cleavage, linkage to a cellular ligand or other protein. Any of a variety of chemical modifications can be carried out by known techniques, including, without limitation, specific chemical cleavage, acetylation, formylation, metabolic synthesis of tunicamycin, etc. using established procedures. Additionally, the derivative can contain one or more non-natural amino acids, e.g., using amber suppression technology (see, e.g., U.S. Pat. No. 6,964,859; incorporated herein by reference).

As used herein, the term "diabodies" refers to bivalent antibodies comprising two polypeptide chains, in which each polypeptide chain includes VH and VL domains joined by a linker that is too short (e.g., a linker composed of five amino acids) to allow for intramolecular association of VH and VL domains on the same peptide chain. This configuration forces each domain to pair with a complementary domain on another polypeptide chain so as to form a homodimeric structure. Accordingly, the term "triabodies" refers to trivalent antibodies comprising three peptide chains, each of which contains one VH domain and one VL domain joined by a linker that is exceedingly short (e.g., a linker composed of 1-2 amino acids) to permit intramolecular association of VH and VL domains within the same peptide chain. In order to fold into their native structure, peptides configured in this way typically trimerize so as to position the VH and VL domains of neighboring peptide chains spatially proximal to one another to permit proper folding (see Holliger et al., Proc. Natl. Acad. Sci. USA 90:6444-48, 1993; incorporated herein by reference).

As used herein, a "dual variable domain immunoglobulin" ("DVD-lg") refers to an antibody that combines the target-binding variable domains of two monoclonal antibodies via linkers to create a tetravalent, dual-targeting single agent. (Gu et al., Meth. Enzymol., 502:25-41, 2012; incorporated by reference herein).

As used herein, the term "endogenous" describes a molecule (e.g., a polypeptide, nucleic acid, or cofactor) that is found naturally in a particular organism (e.g., a human) or in a particular location within an organism (e.g., an organ, a tissue, or a cell, such as a human cell).

As used herein, the term "exogenous" describes a molecule (e.g., a polypeptide, nucleic acid, or cofactor) that is not found naturally in a particular organism (e.g., a human) or in a particular location within an organism (e.g., an organ, a tissue, or a cell, such as a human cell). Exogenous materials include those that are provided from an external source to an organism or to cultured matter extracted there from.

As used herein, the term "framework region" or "FW region" includes amino acid residues that are adjacent to the CDRs. FW region residues may be present in, for example, human antibodies, rodent-derived antibodies (e.g., murine antibodies), humanized antibodies, primatized antibodies, chimeric antibodies, antibody fragments (e.g., Fab fragments), single-chain antibody fragments (e.g., scFv fragments), antibody domains, and bispecific antibodies, among others.

As used herein, the term "heterospecific antibodies" refers to monoclonal, preferably human or humanized, antibodies that have binding specificities for at least two different antigens. Traditionally, the recombinant production of heterospecific antibodies is based on the co-expression of two immunoglobulin heavy chain-light chain pairs, where the two heavy chains have different specificities (Milstein et al., Nature 305:537, 1983). Similar procedures are disclosed, e.g., in WO 93/08829, U.S. Pat. Nos. 6,210,668; 6,193,967; 6,132,992; 6,106,833; 6,060,285; 6,037,453; 6,010,902; 5,989,530; 5,959,084; 5,959,083; 5,932,448; 5,833,985; 5,821,333; 5,807,706; 5,643,759, 5,601,819; 5,582,996, 5,496,549, 4,676,980, WO 91/00360, WO 92/00373, EP 03089, Traunecker et al., EMBO J. 10:3655 (1991), Suresh et al., Methods in Enzymology 121:21 0 (1986); incorporated herein by reference. Heterospecific antibodies can include Fc mutations that enforce correct chain association in multi-specific antibodies, as described by Klein et al, mAbs 4(6):653-663, 2012; incorporated herein by reference.

As used herein, the term "human antibody" refers to an antibody in which substantially every part of the protein (e.g., CDR, framework, $C_L$, $C_H$ domains (e.g., $C_H1$, $C_H2$, $C_H3$), hinge, ($V_L$, $V_H$)) is substantially non-immunogenic in humans, with only minor sequence changes or variations. A human antibody can be produced in a human cell (e.g., by recombinant expression), or by a non-human animal or a prokaryotic or eukaryotic cell that is capable of expressing functionally rearranged human immunoglobulin (e.g., heavy chain and/or light chain) genes. Further, when a human antibody is a single-chain antibody, it can include a linker peptide that is not found in native human antibodies. For example, an Fv can comprise a linker peptide, such as two to about eight glycine or other amino acid residues, which connects the variable region of the heavy chain and the variable region of the light chain. Such linker peptides are considered to be of human origin. Human antibodies can be made by a variety of methods known in the art including phage display methods using antibody libraries derived from human immunoglobulin sequences. See U.S. Pat. Nos. 4,444,887 and 4,716,111; and PCT publications WO 1998/46645; WO 1998/50433; WO 1998/24893; WO 1998/16654; WO 1996/34096; WO 1996/33735; and WO 1991/10741; incorporated herein by reference. Human antibodies can also be produced using transgenic mice that are incapable of expressing functional endogenous immunoglobulins, but which can express human immunoglobulin genes. See, e.g., PCT publications WO 98/24893; WO 92/01047; WO 96/34096; WO 96/33735; U.S. Pat. Nos. 5,413,923; 5,625,126; 5,633,425; 5,569,825; 5,661,016; 5,545,806; 5,814,318; 5,885,793; 5,916,771; and 5,939,598; incorporated by reference herein.

As used herein, the term "humanized" antibodies refers to forms of non-human (e.g., murine) antibodies that are chimeric immunoglobulins, immunoglobulin chains or fragments thereof (such as Fv, Fab, Fab', $F(ab')_2$ or other target-binding subdomains of antibodies) which contain minimal sequences derived from non-human immunoglobulin. In general, the humanized antibody will comprise substantially all of at least one, and typically two, variable domains, in which all or substantially all of the CDR regions correspond to those of a non-human immunoglobulin. All or substantially all of the FR regions may also be those of a human immunoglobulin sequence. The humanized antibody can also comprise at least a portion of an immunoglobulin constant region (Fc), typically that of a human immunoglobulin consensus sequence. Methods of antibody humanization are known in the art. See, e.g., Riechmann et al., Nature 332:323-7, 1988; U.S. Pat. Nos. 5,530,101; 5,585,089; 5,693,761; 5,693,762; and 6,180,370 to Queen et al; EP239400; PCT publication WO 91/09967; U.S. Pat. No. 5,225,539; EP592106; and EP519596; incorporated herein by reference.

As used herein, the term "monoclonal antibody" refers to an antibody that is derived from a single clone, including any eukaryotic, prokaryotic, or phage clone, and not the method by which it is produced.

As used herein, the term "multi-specific antibodies" refers to antibodies that exhibit affinity for more than one target antigen. Multi-specific antibodies can have structures similar to full immunoglobulin molecules and include Fc regions, for example IgG Fc regions. Such structures can include, but not limited to, IgG-Fv, lgG-(scFv)2, DVD-lg, (scFv)2-(scFv)2-Fc and (scFv)2-Fc-(scFv)2. In case of lgG-(scFv)2, the scFv can be attached to either the N-terminal or the C-terminal end of either the heavy chain or the light chain. Exemplary multi-specific molecules have been reviewed by Kontermann, 2012, mAbs 4(2):182-197, Yazaki et al., 2013, Protein Engineering, Design & Selection 26(3):1 87-1 93, and Grote et al., 2012, in Proetzel & Ebersbach (eds.), Antibody Methods and Protocols, Methods in Molecular Biology vol. 901, chapter 16:247-263; incorporated herein by reference. Exemplary multi-specific molecules that lack Fc regions and into which antibodies or antibody fragments can be incorporated include scFv dimers (diabodies), trimers (triabodies) and tetramers (tetrabodies), Fab dimers (conjugates by adhesive polypeptide or protein domains) and Fab trimers (chemically conjugated), are described by Hudson and Souriau, 2003, Nature Medicine 9:129-134; incorporated herein by reference.

As used herein, the term "percent (%) sequence identity" refers to the percentage of amino acid (or nucleic acid) residues of a candidate sequence that are identical to the amino acid (or nucleic acid) residues of a reference sequence after aligning the sequences and introducing gaps, if necessary, to achieve the maximum percent sequence identity (e.g., gaps can be introduced in one or both of the candidate and reference sequences for optimal alignment and non-homologous sequences can be disregarded for comparison purposes). Alignment for purposes of determining percent sequence identity can be achieved in various ways that are within the skill in the art, for instance, using publicly available computer software, such as BLAST, ALIGN, or Megalign (ONASTAR) software. Those skilled in the art can determine appropriate parameters for measuring alignment, including any algorithms needed to achieve maximal alignment over the full length of the sequences being compared. For example, a reference sequence aligned for comparison with a candidate sequence may show that the candidate sequence exhibits from 50% to 100% sequence identity across the full length of the candidate sequence or a selected portion of contiguous amino acid (or nucleic acid) residues of the candidate sequence. The length of the candidate sequence aligned for comparison purposes may be, for example, at least 30%, (e.g., 30%, 40, 50%, 60%, 70%, 80%, 90%, or 100%) of the length of the reference sequence. When a 5 position in the candidate sequence is occupied by the same amino acid residue as the corresponding position in the reference sequence, then the molecules are identical at that position.

As used herein, the term "primatized antibody" refers to an antibody comprising framework regions from primate-derived antibodies and other regions, such as CDRs and constant regions, from antibodies of a non-primate source. Methods for producing primatized antibodies are known in the art. See e.g., U.S. Pat. Nos. 5,658,570; 5,681,722; and 5,693,780; incorporated herein by reference.

As used herein, the term "operatively linked" in the context of a polynucleotide fragment is intended to mean that the two polynucleotide fragments are joined such that the amino acid sequences encoded by the two polynucleotide fragments remain in-frame.

As used herein, the terms "regulatory element" and the like refer to promoters, enhancers, and other expression control elements (e.g., polyadenylation signals) that control the transcription or translation of the antibody chain genes. Such regulatory sequences are described, for example, in Goeddel, Gene Expression Technology: Methods in Enzymology 185 (Academic Press, San Diego, CA, 1990); incorporated herein by reference.

As used herein, the terms "subject" and "patient" refer to an organism that receives treatment for a particular disease or condition as described herein (such as cancer or an infectious disease). Examples of subjects and patients include mammals, such as humans, receiving treatment for diseases or conditions, for example, cell proliferation disorders, such as cancer.

As used herein, the term "scFv" refers to a single-chain Fv antibody in which the variable domains of the heavy chain and the light chain from an antibody have been joined to form one chain. scFv fragments contain a single polypeptide chain that includes the variable region of an antibody light chain (VL) (e.g., CDR-L1, CDR-L2, and/or CDR-L3) and the variable region of an antibody heavy chain (VH) (e.g., CDR-H1, CDR-H2, and/or CDR-H3) separated by a linker. The linker that joins the VL and VH regions of a scFv fragment can be a peptide linker composed of proteinogenic amino acids. Alternative linkers can be used to so as to increase the resistance of the scFv fragment to proteolytic degradation (e.g., linkers containing D-amino acids), in order to enhance the solubility of the scFv fragment (e.g., hydrophilic linkers such as polyethylene glycol-containing linkers or polypeptides containing repeating glycine and serine residues), to improve the biophysical stability of the molecule (e.g., a linker containing cysteine residues that form intramolecular or intermolecular disulfide bonds), or to attenuate the immunogenicity of the scFv fragment (e.g., linkers containing glycosylation sites). scFv molecules are known in the art and are described, e.g., in U.S. Pat. No. 5,892,019, Flo et al., (Gene 77:51, 1989); Bird et al., (Science 242:423, 1988); Pantoliano et al., (Biochemistry 30:10117, 1991); Milenic et al., (Cancer Research 51:6363, 1991); and Takkinen et al., (Protein Engineering 4:837, 1991). The VL and VH domains of a scFv molecule can be derived from one or more antibody molecules. It will also be understood by one of ordinary skill in the art that the variable regions of the scFv molecules of the invention can be modified such that they vary in amino acid sequence from the antibody molecule from which they were derived. For example, in some embodiments, nucleotide or amino acid substitutions leading to conservative substitutions or changes at amino acid residues can be made (e.g., in CDR and/or framework residues). Alternatively or in addition, mutations are made to CDR amino acid residues to optimize antigen binding using art recognized techniques. scFv fragments are described, for example, in WO 2011/084714; incorporated herein by reference.

As used herein, the phrase "specifically binds" refers to a binding reaction which is determinative of the presence of an antigen in a heterogeneous population of proteins and other biological molecules that is recognized, e.g., by an antibody or antigen-binding fragment thereof, with particularity. An antibody or antigen-binding fragment thereof that specifically binds to an antigen may bind to the antigen with a $K_D$ of less than 100 nM. For example, an antibody or antigen-binding fragment thereof that specifically binds to an antigen may bind to the antigen with a $K_D$ of up to 100 nM (e.g., between 1 pM and 100 nM). An antibody or antigen-binding fragment thereof that does not exhibit specific binding to a particular antigen or epitope thereof may exhibit a $K_D$ of greater than 100 nM (e.g., greater than 500 nm, 1 μM, 100 μM, 500 μM, or 1 mM) for that particular antigen or epitope thereof. A variety of immunoassay formats may be used to select antibodies specifically immunoreactive with a particular protein or carbohydrate. For example, solid-phase ELISA immunoassays are routinely used to select antibodies specifically immunoreactive with a protein or carbohydrate. See, Harlow & Lane, Antibodies, A Laboratory Manual, Cold Spring Harbor Press, New York (1988) and Harlow & Lane, Using Antibodies, A Laboratory Manual, Cold Spring Harbor Press, New York (1999), for a description of immunoassay formats and conditions that can be used to determine specific immunoreactivity.

As used herein, the term "transfection" refers to any of a wide variety of techniques commonly used for the introduction of exogenous DNA into a prokaryotic or eukaryotic host cell, e.g., electroporation, lipofection, calcium-phosphate precipitation, DEAE-dextran transfection and the like.

As used herein, the terms "treat" or "treatment" refer to therapeutic treatment, in which the object is to prevent or slow down (lessen) an undesired physiological change or disorder, such as the progression of a cell proliferation disorder, such as cancer. Beneficial or desired clinical results include, but are not limited to, alleviation of symptoms, diminishment of extent of disease, stabilized (i.e., not worsening) state of disease, delay or slowing of disease progression, amelioration or palliation of the disease state, and remission (whether partial or total), whether detectable or undetectable. Those in need of treatment include those already with the condition or disorder, as well as those prone to have the condition or disorder or those in which the condition or disorder is to be prevented.

As used herein, the term "vector" refers to a nucleic acid vector, e.g., a DNA vector, such as a plasmid, a RNA vector, virus or other suitable replicon (e.g., viral vector). A variety of vectors have been developed for the delivery of polynucleotides encoding exogenous proteins into a prokaryotic or eukaryotic cell. Examples of such expression vectors are disclosed in, e.g., WO 1994/11026; incorporated herein by reference. Expression vectors of the invention may contain one or more additional sequence elements used for the expression of proteins and/or the integration of these polynucleotide sequences into the genome of a host cell, such as a mammalian cell (e.g., a human cell). Exemplary vectors that can be used for the expression of antibodies and antibody fragments described herein include plasmids that contain regulatory sequences, such as promoter and enhancer regions, which direct gene transcription. Vectors may contain nucleic acids that modulate the rate of translation of a target gene or that improve the stability or nuclear export of the mRNA that results from gene transcription. These sequence elements may include, e.g., 5' and 3' untranslated regions, an internal ribosomal entry site (IRES), and polyadenylation signal site in order to direct efficient transcription of the gene carried on the expression vector. The vectors described herein may also contain a polynucleotide encoding a marker for selection of cells that contain such a vector. Examples of a suitable marker include genes that encode resistance to antibiotics, such as ampicillin, chloramphenicol, kanamycin, or nourseothricin.

As used herein, the term "VH" refers to the variable region of an immunoglobulin heavy chain of an antibody, including the heavy chain of an Fv, scFv, or Fab. References to "VL" refer to the variable region of an immunoglobulin light chain, including the light chain of an Fv, scFv, dsFv or Fab. Antibodies (Abs) and immunoglobulins (Igs) are glycoproteins having the same structural characteristics. While antibodies exhibit binding specificity to a specific target, immunoglobulins include both antibodies and other antibody-like molecules which lack target specificity. Native antibodies and immunoglobulins are usually heterotetrameric glycoproteins of about 1 50,000 Daltons, composed of two identical light (L) chains and two identical heavy (H) chains. Each heavy chain of a native antibody has at the amino terminus a variable domain (VH) followed by a number of constant domains. Each light chain of a native antibody has a variable domain at the amino terminus (VL) and a constant domain at the carboxy terminus.

Gene Definitions

As used herein, "C2L" refers to a orthopoxvirus gene, such as a gene that encodes a kelch-like protein. Non-limiting examples of protein sequences encoding the C2L gene are listed in tables 31-35 below. The term "C2L" may also include fragments or variants of the proteins listed in the tables below, or homologous genes from another orthopoxvirus strain.

As used herein, "C1L" refers to a orthopoxvirus gene. Non-limiting examples of protein sequences encoding the C1L gene are listed in tables 31-35 below. The term "C1L" may also include fragments or variants of the proteins listed in the tables below, or homologous genes from another orthopoxvirus strain.

As used herein, "N1L" refers to a orthopoxvirus gene, such as a gene that encodes a BCL-2 inhibitor. Non-limiting examples of protein sequences encoding the N1L gene are listed in tables 31-35 below. The term "N1L" may also include fragments or variants of the proteins listed in the tables below, or homologous genes from another orthopoxvirus strain.

As used herein, "N2L" refers to a orthopoxvirus gene, such as a gene that encodes a TLR signaling inhibitor. Non-limiting examples of protein sequences encoding the N2L gene are listed in tables 31-35 below. The term "N2L" may also include fragments or variants of the proteins listed in the tables below, or homologous genes from another orthopoxvirus strain.

As used herein, "ML" refers to a orthopoxvirus gene, such as a gene that encodes an Ankyrin repeat protein. Non-limiting examples of protein sequences encoding the M1L gene are listed in tables 31-35 below. The term "M1L" may also include fragments or variants of the proteins listed in the tables below, or homologous genes from another orthopoxvirus strain.

As used herein, "M2L" refers to a orthopoxvirus gene, such as a gene that encodes an NF-κB inhibitor. Non-limiting examples of protein sequences encoding the M2L gene are listed in tables 31-35 below. The term "M2L" may also include fragments or variants of the proteins listed in the tables below, or homologous genes from another orthopoxvirus strain.

As used herein, "K1L" refers to a orthopoxvirus gene, such as a gene that encodes an NF-κB inhibitor. Non-limiting examples of protein sequences encoding the K1L gene are listed in tables 31-35 below. The term "K1 L" may also include fragments or variants of the proteins listed in the tables below, or homologous genes from another orthopoxvirus strain.

As used herein, "K2L" refers to a orthopoxvirus gene, such as a gene that encodes an Ankyrin repeat protein. Non-limiting examples of protein sequences encoding the K2L gene are listed in tables 31-35 below. The term "K2L" may also include fragments or variants of the proteins listed in the tables below, or homologous genes from another orthopoxvirus strain.

As used herein, "K3L" refers to a orthopoxvirus gene, such as a gene that encodes a PKR inhibitor. Non-limiting examples of protein sequences encoding the K3L gene are listed in tables 31-35 below. The term "K3L" may also include fragments or variants of the proteins listed in the tables below, or homologous genes from another orthopoxvirus strain.

As used herein, "K4L" refers to a orthopoxvirus gene, such as a gene that encodes a pbospholipase-D. Non-limiting examples of protein sequences encoding the K4L gene are listed in tables 31-35 below. The term "K4L" may also include fragments or variants of the proteins listed in the tables below, or homologous genes from another orthopoxvirus strain.

As used herein, "K5L" refers to a orthopoxvirus gene, such as a gene that encodes a monoglyceride lipase. Non-limiting examples of protein sequences encoding the K5L gene are listed in tables 31-35 below. The term "K5L" may also include fragments or variants of the proteins listed in the tables below, or homologous genes from another orthopoxvirus strain.

As used herein, "K6L" refers to a orthopoxvirus gene, such as a gene that encodes a monoglyceride lipase. Non-limiting examples of protein sequences encoding the K6L gene are listed in tables 31-35 below. The term "K6L" may also include fragments or variants of the proteins listed in the tables below, or homologous genes from another orthopoxvirus strain.

As used herein, "K7R" refers to a orthopoxvirus gene, such as a gene that encodes an NF-κB inhibitor. Non-limiting examples of protein sequences encoding the K7R gene are listed in tables 31-35 below. The term "K7R" may also include fragments or variants of the proteins listed in the tables below, or homologous genes from another orthopoxvirus strain.

As used herein, "F1L" refers to a orthopoxvirus gene, such as a gene that encodes a caspase-9 inhibitor. Non-limiting examples of protein sequences encoding the F1L gene are listed in tables 31-35 below. The term "F1L" may also include fragments or variants of the proteins listed in the tables below, or homologous genes from another orthopoxvirus strain.

As used herein, "F2L" refers to a orthopoxvirus gene, such as a gene that encodes a dUTPase. Non-limiting examples of protein sequences encoding the F2L gene are listed in tables 31-35 below. The term "F2L" may also include fragments or variants of the proteins listed in the tables below, or homologous genes from another orthopoxvirus strain.

As used herein, "F3L" refers to a orthopoxvirus gene, such as a gene that encodes a kelch-like protein. Non-limiting examples of protein sequences encoding the F3L gene are listed in tables 31-35 below. The term "F1L" may also include fragments or variants of the proteins listed in the tables below, or homologous genes from another orthopoxvirus strain.

As used herein, "B14R" refers to a orthopoxvirus gene. Non-limiting examples of protein sequences encoding the B14R gene are listed in tables 36-40 below. The term "B14R" may also include fragments or variants of the proteins listed in the tables below, or homologous genes from another orthopoxvirus strain.

As used herein, "B15R" refers to a orthopoxvirus gene. Non-limiting examples of protein sequences encoding the B15R gene are listed in tables 36-40 below. The term "B15R" may also include fragments or variants of the proteins listed in the tables below, or homologous genes from another orthopoxvirus strain.

As used herein, "B16R" refers to a orthopoxvirus gene, such as a gene that encodes a IL-1-beta inhibitor. Non-limiting examples of protein sequences encoding the B16R gene are listed in tables 31-35 below. The term "B16R" may also include fragments or variants of the proteins listed in the tables below, or homologous genes from another orthopoxvirus strain.

As used herein, "B17L" refers to a orthopoxvirus gene. Non-limiting examples of protein sequences encoding the B17L gene are listed in tables 36-40 below. The term "B17L" may also include fragments or variants of the proteins listed in the tables below, or homologous genes from another orthopoxvirus strain.

As used herein, "B18R" refers to a orthopoxvirus gene, such as a gene that encodes an Ankyrin repeat protein. Non-limiting examples of protein sequences encoding the B18R gene are listed in tables 36-40 below. The term "B18R" may also include fragments or variants of the proteins listed in the tables below, or homologous genes from another orthopoxvirus strain.

As used herein, "B19R" refers to a orthopoxvirus gene, such as a gene that encodes a IFN-alpha-beta-receptor-like secreted glycoprotein. Non-limiting examples of protein sequences encoding the B19R gene are listed in tables 36-40 below. The term "B19R" may also include fragments or variants of the proteins listed in the tables below, or homologous genes from another orthopoxvirus strain.

As used herein, "B20R" refers to a orthopoxvirus gene, such as a gene that encodes an Ankyrin repeat protein. Non-limiting examples of protein sequences encoding the B20R gene are listed in tables 36-40 below. The term "B20R" may also include fragments or variants of the proteins listed in the tables below, or homologous genes from another orthopoxvirus strain.

As used herein, "B8R" refers to a orthopoxvirus gene, such as a gene that encodes a secreted protein with homology to the gamma interferon (IFN-γ). A nonlimiting example of a protein sequence encoded by an exemplary B8R gene in a Copenhagen strain of the vaccinia virus is given in UniProtKB database entry P21004 and is reproduced below:

```
                                    (SEQ ID NO: 209)
MRYIIILAVLFINSIHAKITSYKFESVNFDSKIEWTGDGLYNISLKNYGI

KTWQTMYTNVPEGTYDISAFPKNDFVSFWVKFEQGDYKVEEYCTGLCVEV

KIGPPTVTLTEYDDHINLYIEHPYATRGSKKIPIYKRGDMCDIYLLYTAN

FTFGDSEEPVTYDIDDYDCTSTGCSIDFATTEKVCVTAQGATEGFLEKIT

PWSSEVCLTPKKNVYTCAIRKEDVPNFKDKMARVIKRKFNKQSQSYLTKF

LGSTSNDVTTFLSMLNLTKYS
```

The term "B8R" may also include fragments or variants of the proteins listed above, or homologous genes from another orthopoxvirus strain. Variants include without limitation those sequences having 85 percent or greater identity to the sequences disclosed herein.

BRIEF DESCRIPTION OF THE FIGURES

FIG. 42 shows the phenotypic characterization of HeLa cells infected with various vaccinia strains.

FIG. 44 shows 5p3p vaccinia strains do not induce pox lesions compared to wildtype strains.

DETAILED DESCRIPTION

Figure 1:
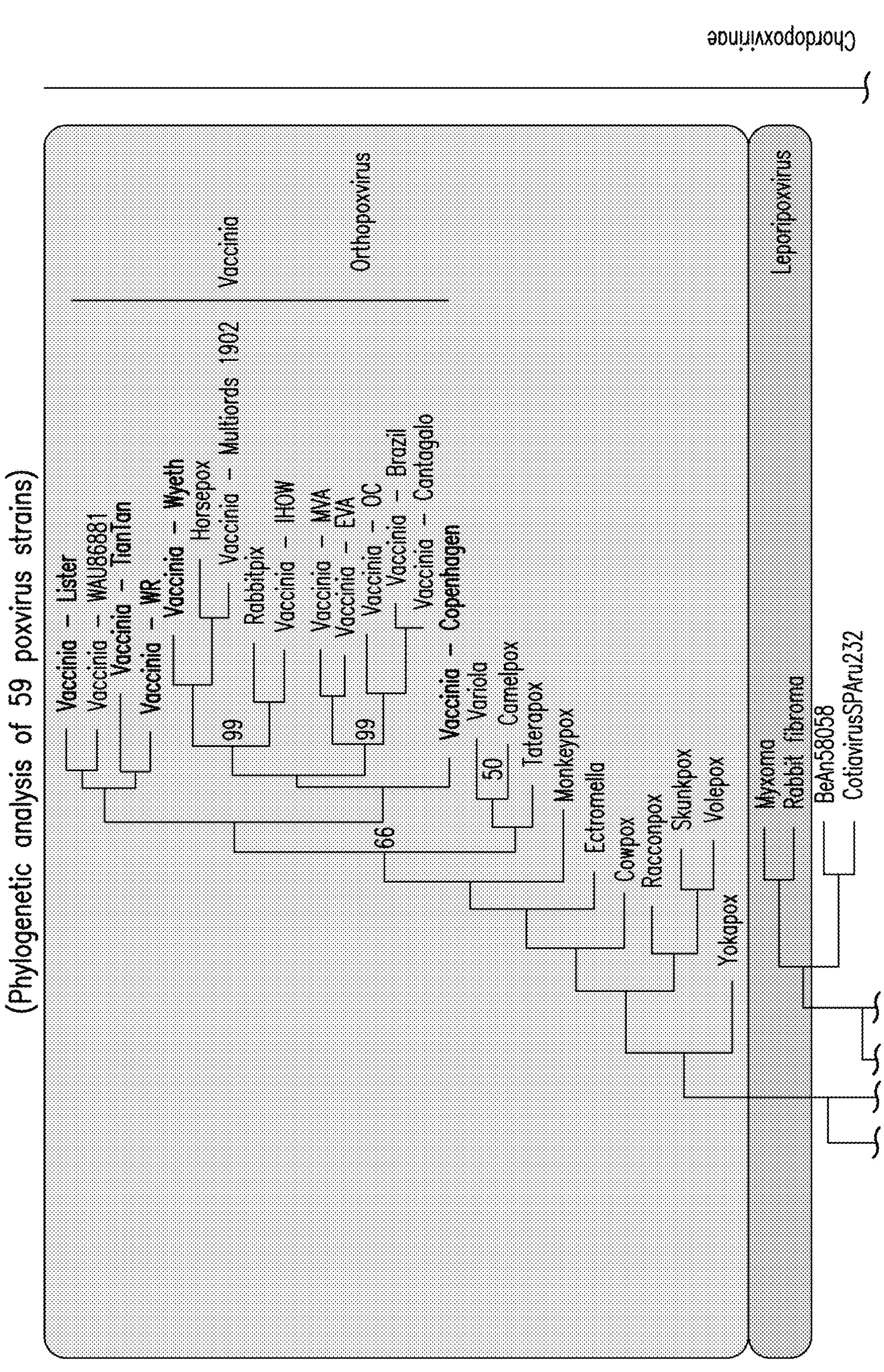
FIG. 1 shows the phylogenetic analysis of 59 poxvirus strains, including the Orthopoxvirus virus strains.
Figure 1:
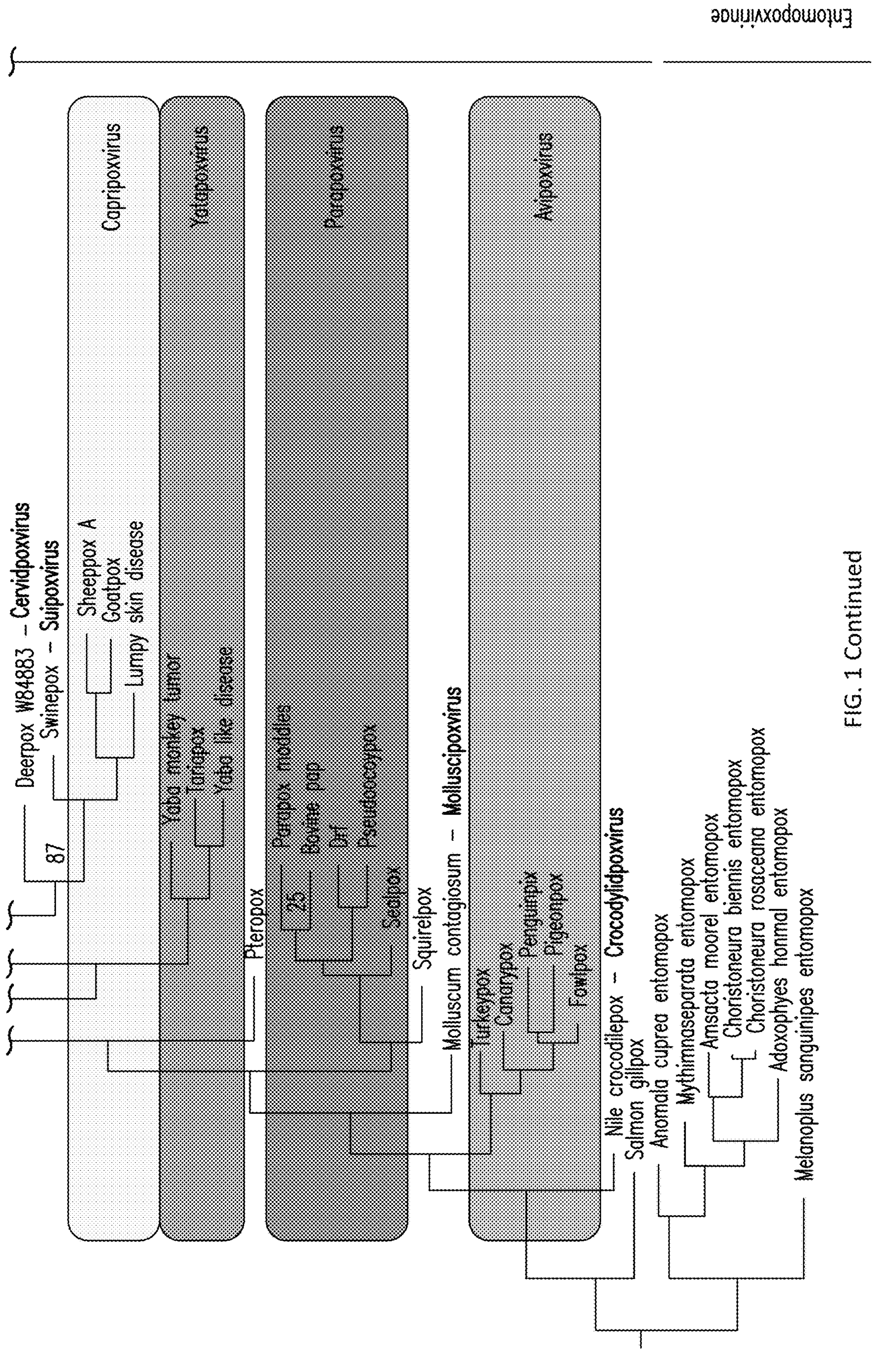

The present invention features genetically modified orthopoxviruses, such as vaccinia viruses (e.g. Copenhagen, Western Reserve, Wyeth, Lister, EM63, ACAM2000, CV-1, modified vaccinia Ankara (MVA), Dairen I, GLV-1h68, IHD-J, L-IVP, LC16m8, LC16mO, Tashkent, Tian Tan, and WAU86/88-1 viruses), as well as the use of the same for the treatment of various cancers. The invention is based in part on the surprising discovery that orthopoxviruses, such as Copenhagen, Western Reserve, Wyeth, Lister, EM63, ACAM2000, CV-1, modified vaccinia Ankara (MVA), Dairen I, GLV-1h68, IHD-J, L-IVP, LC16m8, LC16mO, Tashkent, Tian Tan, and WAU86/88-1 viruses, exhibit markedly improved oncolytic activity, replication in tumors, infectivity, immune evasion, tumor persistence, capacity for incorporation of exogenous DNA sequences, and amenability for large scale manufacturing when the viruses are engineered to contain deletions in one or more, or all, of the C2L, C1L, N1L, N2L, M1L, M2L, K1L, K2L, K3L, K4L, K5L, K6L, K7R, F1L, F2L, F3L, B14R, B15R, B16R, B17L, B18R, B19R, B20R, K ORF A, K ORF B, B ORF E, B ORF F, B ORF G, B21R, B22R, B23R, B24R, B25R, B26R, B27R, B28R, and B29R genes. In various embodiments of the invention, the modified orthopox viruses contain a deletion of the B8R gene. While inactive in mice, the B8R gene neutralizes antiviral activity of human IFN-γ. In various embodiments, at least one transgene is subsequently inserted into locus of the B8R gene (now deleted) through a homologous recombination targeting strategy. In various embodiments, the modified orthopoxvirus expresses at least one of three transgenes: IL-12-TM, FLT3-L and anti-CTLA4 antibody.

The orthopoxviruses described herein can be administered to a patient, such as a mammalian patient (e.g., a human patient) to treat a variety of cell proliferation disorders, including a wide range of cancers. The sections that follow describe orthopoxviruses and genetic modifications thereto, as well as methods of producing and propagating genetically modified orthopoxviruses and techniques for administering the same to a patient.

Poxvirus

Generally, a poxvirus viral particle is oval or brick-shaped, measuring some 200-400 nm long. The external surface is ridged in parallel rows, sometimes arranged helically. Such particles are extremely complex, containing over 100 distinct proteins. The extracellular forms contain two membranes (EEV: extracellular enveloped virions), whereas intracellular particles only have an inner membrane (IMV: intracellular mature virions). The outer surface is composed of lipid and protein that surrounds the core, which is composed of a tightly compressed nucleoprotein. Antigenically, poxviruses are also very complex, inducing both specific and cross-reacting antibodies. There are at least ten enzymes present in the particle, mostly concerned with nucleic acid metabolism/genome replication.

The genome of the wild-type poxvirus is linear double-stranded DNA of 130-300 Kbp. The ends of the genome have a terminal hairpin loop with several tandem repeat sequences. Several poxvirus genomes have been sequenced, with most of the essential genes being located in the central part of the genome, while non-essential genes are located at the ends. There are about 250 genes in the poxvirus genome. Replication takes place in the cytoplasm, as the virus is sufficiently complex to have acquired all the functions necessary for genome replication. There is some contribution by the cell, but the nature of this contribution is not clear. However, even though poxvirus gene expression and genome replication occur in enucleated cells, maturation is blocked, indicating some role by the cell.

Once into the cell cytoplasm, gene expression is carried out by viral enzymes associated with the core. Expression is divided into 2 phases: early genes: which represent about of 50% genome, and are expressed before genome replication, and late genes, which are expressed after genome replication. The temporal control of expression is provided by the late promoters, which are dependent on DNA replication for activity. Genome replication is believed to involve self-priming, leading to the formation of high molecular weight concatemers, which are subsequently cleaved and repaired to make virus genomes. Viral assembly occurs in the cytoskeleton and probably involves interactions with the cytoskeletal proteins (e.g., actin-binding proteins). Inclusions form in the cytoplasm that mature into virus particles. Cell to cell spread may provide an alternative mechanism for spread of infection. Overall, replication of this large, complex virus is rather quick, taking just 12 hours on average. At least nine different poxviruses cause disease in humans, but variola virus and vaccinia are the best known. Variola strains are divided into variola major (25-30% fatalities) and variola minor (same symptoms but less than 1% death rate). Infection with both viruses occurs naturally by the respiratory route and is systemic, producing a variety of symptoms, but most notably with variola characteristic pustules and scarring of the skin.

Vaccinia Virus as a Species of Orthopoxvirus

Vaccinia virus is a large, complex enveloped virus having a linear double-stranded DNA genome of about 190K by and encoding for approximately 250 genes. Vaccinia is well-known for its role as a vaccine that eradicated smallpox. Post-eradication of smallpox, scientists have been exploring the use of vaccinia as a tool for delivering genes into biological tissues (gene therapy and genetic engineering). Vaccinia virus is unique among DNA viruses as it replicates only in the cytoplasm of the host cell. Therefore, the large genome is required to code for various enzymes and proteins needed for viral DNA replication. During replication, vaccinia produces several infectious forms, which differ in their outer membranes: the intracellular mature virion (IMV), the intracellular enveloped virion (IEV), the cell-associated enveloped virion (CEV), and the extracellular enveloped virion (EEV). IMV is the most abundant infectious form and is thought to be responsible for spread between hosts. On the other hand, the CEV is believed to play a role in cell-to-cell spread and the EEV is thought to be important for long-range dissemination within the host organism.

Vaccinia virus is closely related to the virus that causes cowpox. The precise origin of vaccinia is unknown, but the most common view is that vaccinia virus, cowpox virus, and variola virus (the causative agent for smallpox) were all derived from a common ancestral virus. There is also speculation that vaccinia virus was originally isolated from horses. A vaccinia virus infection is mild and typically asymptomatic in healthy individuals, but it may cause a mild rash and fever, with an extremely low rate of fatality. An immune response generated against a vaccinia virus infection protects that person against a lethal smallpox infection. For this reason, vaccinia virus was used as a live-virus vaccine against smallpox. The vaccinia virus vaccine is safe because it does not contain the smallpox virus, but occasionally certain complications and/or vaccine adverse effects may arise, especially if the vaccine is immunocompromised.

Exemplary strains of the vaccinia virus include, but are not limited to, Copenhagen, Western Reserve, Wyeth, Lister, EM63, ACAM2000, CV-1, modified vaccinia Ankara (MVA), Dairen I, GLV-1h68, IHD-J, L-IVP, LC16m8, LC16mO, Tashkent, Tian Tan, and WAU86/88-1.

Thymidine Kinase Mutants

Several current clinical studies testing vaccinia virus as an oncolytic virus harbor deletions in the viral Thymidine Kinase (TK) gene. This deletion attenuates the virus, rendering the virus dependent upon the activity of cellular thymidine kinase for DNA replication and, thus, viral propagation. Cellular thymidine kinase is expressed at a low level in most normal tissues and at elevated levels in many cancer cells. Through metabolic targeting, TK-viruses can grow in cells that have a high metabolic rate (e.g., healthy cells or tumor cells) and will not grow well in cells that have low levels of thymidine kinase. Since there exist quiescent tumour cells (e.g., cancer stem cells), TK-viruses are likely compromised in their ability to kill this population of cancer cells just as chemotherapy is largely ineffective. The modified viral vectors described in this disclosure retains virus synthetic machinery (including TK) and may propagate in quiescent cancer cells. The viral modifications of this disclosure may allow the virus to be highly selective without deleting TK or other DNA metabolizing enzymes (e.g., ribonucleotide reductase) and could be more effective in tumors with a low metabolic rate.

Virus Propagation

The present invention features poxviruses, including those constructed with one or more gene deletions compared to wild-type, such that the virus exhibits desirable properties for use against cancer cells, while being less toxic or non-toxic to non-cancer cells. This section summarizes various protocols, by way of example, for producing recombinant poxviruses described herein, such as methods for generating mutated viruses through the use of recombinant DNA technology.

For example, to generate mutations in the poxvirus genome, native and modified polypeptides may be encoded by a nucleic acid molecule comprised in a vector. Vectors include plasmids, cosmids, viruses (bacteriophage, animal viruses, and plant viruses), and artificial chromosomes (e.g., YACs). One of skill in the art would be well equipped to construct a vector through standard recombinant techniques, which are described in Sambrook et al., (1989) and Ausubel et al., 1994, both incorporated herein by reference. In addition to encoding a modified polypeptide such as modified gelonin, a vector may encode non-modified polypeptide, sequences such as a tag or targeting molecule.

In order to propagate a vector in a host cell, it may contain one or more origins of replication sites (often termed "ori"), which is a specific nucleic acid sequence at which replication is initiated. Alternatively an autonomously replicating sequence (ARS) can be employed if the host cell is yeast.

In the context of expressing a heterologous nucleic acid sequence, "host cell" refers to a prokaryotic or eukaryotic cell, and it includes any transformable organisms that is capable of replicating a vector and/or expressing a heterologous gene encoded by a vector. A host cell can, and has been, used as a recipient for vectors or viruses (which does not qualify as a vector if it expresses no exogenous polypeptides). A host cell may be "transfected" or "transformed," which refers to a process by which exogenous nucleic acid, such as a modified protein-encoding sequence, is transferred or introduced into the host cell. A transformed cell includes the primary subject cell and its progeny. Host cells may be derived from prokaryotes or eukaryotes, including yeast cells, insect cells, and mammalian cells, depending upon whether the desired result is replication of the vector or expression of part or all of the vector-encoded nucleic acid sequences. Numerous cell lines and cultures are available for use as a host cell, and they can be obtained through the American Type Culture Collection (ATCC), which is an organization that serves as an archive for living cultures and genetic materials (www.atcc.org). An appropriate host can be determined by one of skill in the art based on the vector backbone and the desired result. A plasmid or cosmid, for example, can be introduced into a prokaryote host cell for replication of many vectors. Bacterial cells used as host cells for vector replication and/or expression include DH5α, JM109, and KCB, as well as a number of commercially available bacterial hosts such as SURE® Competent Cells and SOLOPACK™ Gold Cells (STRATAGENE®, La Jolla, Calif.). Alternatively, bacterial cells such as *E. coli* LE392 could be used as host cells for phage viruses. Appropriate yeast cells include *Saccharomyces cerevisiae, Saccharomyces pombe*, and *Pichia pastoris*. Examples of eukaryotic host cells for replication and/or expression of a vector include HeLa, NIH3T3, Jurkat, 293, Cos, CHO, Saos, and PC12. Many host cells from various cell types and organisms are available and would be known to one of skill in the art. Similarly, a viral vector may be used in conjunction with either a eukaryotic or prokaryotic host cell, particularly one that is permissive for replication or expression of the vector. Some vectors may employ control sequences that allow it to be replicated and/or expressed in both prokaryotic and eukaryotic cells. One of skill in the art would further understand the conditions under which to incubate all of the above described host cells to maintain them and to permit replication of a vector. Also understood and known are techniques and conditions that would allow large-scale production of vectors, as well as production of the nucleic acids encoded by vectors and their cognate polypeptides, proteins, or peptides.

Genetic Modifications to the Orthopoxvirus Genome

Methods of Genetic Modification

Methods for the insertion or deletion of nucleic acids from a target genome include those described herein and known in the art. One such method that can be used for incorporating polynucleotides encoding target genes into a target genome involves the use of transposons. Transposons are polynucleotides that encode transposase enzymes and contain a polynucleotide sequence or gene of interest flanked by 5' and 3' excision sites. Once a transposon has been delivered to a target nucleic acid (e.g., in a host cell), expression of the transposase gene commences and results in active enzymes that cleave the gene of interest from the transposon. This activity is mediated by the site-specific recognition of transposon excision sites by the transposase. In certain cases, these excision sites may be terminal repeats or inverted terminal repeats. Once excised from the transposon, the gene of interest can be integrated into the target genome by transposase-catalyzed cleavage of similar excision sites that exist within the nuclear genome of the cell. This allows the gene of interest to be inserted into the cleaved nuclear DNA at the complementary excision sites, and subsequent covalent ligation of the phosphodiester bonds that join the gene of interest to the DNA of the target genome completes the incorporation process. In certain cases, the transposon may be a retrotransposon, such that the gene encoding the target gene is first transcribed to an RNA product and then reverse-transcribed to DNA before incorporation in the mammalian cell genome. Transposon systems include the piggybac transposon (described in detail in, e.g., WO 2010/085699) and the sleeping beauty transposon (described in detail in, e.g., US2005/0112764), the disclosures of each of which are incorporated herein by reference.

Additional methods for nucleic acid delivery to effect expression of compositions of the present invention are believed to include virtually any method by which a nucleic acid (e.g., DNA, including viral and non-viral vectors) can be introduced into an organelle, a cell, a tissue or an organism, as described herein or as would be known to one of ordinary skill in the art. Such methods include, but are not limited to, direct delivery of DNA such as by injection (U.S. Pat. Nos. 5,994,624, 5,981,274, 5,945,100, 5,780,448, 5,736,524, 5,702,932, 5,656,610, 5,589,466 and 5,580,859, each incorporated herein by reference), including microinjection (Harland and Weintraub, 1985; U.S. Pat. No. 5,789,215, incorporated herein by reference); by electroporation (U.S. Pat. No. 5,384,253, incorporated herein by reference); by calcium phosphate precipitation (Graham and Van Der Eb, 1973; Chen and Okayama, 1987; Rippe et al., 1990); by using DEAE-dextran followed by polyethylene glycol (Gopal, 1985); by direct sonic loading (Fechheimer et al., 1987); by liposome mediated transfection (Nicolau and Sene, 1982; Fraley et al., 1979; Nicolau et al., 1987; Wong et al., 1980; Kaneda et al., 1989; Kato et al., 1991); by microprojectile bombardment (PCT Application Nos. WO 94/09699 and 95/06128; U.S. Pat. Nos. 5,610,042; 5,322,783, 5,563,055, 5,550,318, 5,538,877 and 5,538,880, and each incorporated herein by reference); by agitation with silicon carbide fibers (Kaeppler et al., 1990; U.S. Pat. Nos. 5,302,523 and 5,464,765, each incorporated herein by reference); by *Agrobacterium*-mediated transformation (U.S. Pat. Nos. 5,591,616 and 5,563,055, each incorporated herein by reference); or by PEG-mediated transformation of protoplasts (Omirulleh et al., 1993; U.S. Pat. Nos. 4,684,611 and 4,952,500, each incorporated herein by reference); by desiccation/inhibition-mediated DNA uptake (Potrykus et al., 1985). Through the application of techniques such as these, organelle(s), cell(s), tissue(s) or organism(s) may be stably or transiently transformed.

CopMD5p, CopMD3p, and CopMD5p3p Deletions.

In various embodiments, various genes are deleted to enhance the oncolytic activity of the orthopoxvirus. Most of the deletions described herein are either involved in blocking a host response to viral infection or otherwise have an unknown function. In various embodiments, at least one of the genes depicted in Table 2 are deleted from the recombinant orthopoxvirus genome. In various embodiments, at least 2, 3, 4, 5, 6, 7, 8, 9, 10, 11, 12, 13, 14, 15, 16, 17, 18, 19, 20, 21, 22, 23, 24, 25, 26, 27, 28, 29, 30 or 31 of the genes depicted in Table 2 are deleted from the recombinant orthopox genome. In various embodiments, all of the genes depicted in Table 2 are deleted from the recombinant orthopoxvirus genome. Three exemplary embodiments of the present invention, CopMD5p, CopMD3p and CopMD5p3p, are described herein. Depicted in Table 2 below are clusters of deleted genes and their function in CopMD5p, CopMD3p, and CopMD5p3p virus. In various embodiments, where two copies of an ITR exist, only the right ITR of the genome is deleted and the left ITR remains intact. Deletions are confirmed by whole genome sequencing.

TABLE 2

Deleted genes in Orthopoxviruses

| Name | Category | Function | Virus Deletions | |
|---|---|---|---|---|
| C2L | Host interaction | Inhibits NFkB | CopMD5p | CopMD5p3p |
| C1L | Unknown | Unknown | | |
| N1L | Host interaction | Inhibits NFkB and Apoptosis | | |
| N2L | Host interaction | Inhibits IRF3 | | |
| M1L | Unknown | Unknown | | |
| M2L | Host interaction | Inhibits NFkB and Apoptosis | | |
| K1L | Host interaction | Inhibits PKR and NF-kB | | |
| K2L | Host interaction | Prevents cell fusion | | |
| K3L | Host interaction | Inhibits PKR | | |
| K4L | DNA replication | DNA modifying nuclease | | |
| K5L | Pseudogene | Pseudogene | | |
| K6L | Pseudogene | Pseudogene | | |
| K7R | Host interaction | Inhibits NFkB and IRF3 | | |
| F1L | Host interaction | Inhibits Apoptosis | | |
| F2L | DNA replication | Deoxyuridine triphosphatase | | |
| F3L | Host interaction | Virulence factor | | |
| B14R | Pseudogene | Pseudogene | CopMD3p | |
| B15R | Unknown | Unknown | | |
| B16R | Host interaction | IL-1-beta-inhibitor | | |
| B17L | Unknown | Unknown | | |
| B18R | Unknown | Ankyrin-like | | |
| B19R | Host interaction | Secreted IFNa sequestor | | |
| B20R | Unknown | Ankyrin-like | | |
| B21R-ITR* | Unknown | Unknown | | |
| B22R-ITR* | Unknown | Unknown | | |
| B23R-ITR* | Unknown | Unknown | | |
| B24R-ITR* | Unknown | Unknown | | |
| B25R-ITR* | Unknown | Unknown | | |
| B26R-ITR* | Unknown | Unknown | | |
| B27R-ITR* | Unknown | Unknown | | |
| B28R-ITR* | Pseudogene | TNF-a receptor | | |
| B29R-ITR* | Host interaction | Secreted CC-chemokine sequestor | | |

B8R Gene Deletions.

In various embodiments, the orthopox viruses are further genetically modified to contain deletions in the B8R gene. The vaccinia virus B8R gene encodes a secreted protein with homology to gamma interferon receptor (IFN-7). In vitro, the B8R protein binds to and neutralizes the antiviral activity of several species of gamma inteterferon including human and rat gamma interferon; it does not, however, bind significantly to murine IFN-7. Deleting the B8R gene prevents the impairment of IFN-γ in humans. Deletion of the B8R gene results in enhanced safety without a concomitant reduction in immunogenicity.

Transgene Insertions

In various embodiments, additional transgenes may be inserted into the vector. In various embodiments, one, two or three transgenes are inserted into the locus of the deleted B8R gene. In some strains, in addition to the transgene(s) present at the site of the B8R deletion, the strain also has, at least one transgene is inserted into an additional locus on the orthopox virus that is not the locus of the deleted B8R gene. In various embodiments, at least one transgene is inserted into boundaries of the 5p deletions, at least one transgene is inserted into the boundaries of the 3p deletions or both. In various, embodiments at least three, four, five or more transgenes are inserted into the modified orthopox virus genome.

In various embodiments, the recombinant orthopoxvirus vector can include at least one transgene encoding an immune checkpoint inhibitor. Exemplary immune checkpoint inhibitors for expression by the orthopoxvirus of the compositions and methods of the invention include but are not limited to OX40 ligand, ICOS ligand, anti-CD47 antibody or antigen-binding fragment thereof, anti-CD40/CD40L antibody or antigen-binding fragment thereof, anti-Lag3 antibody or antigen-binding fragment thereof, anti-CTLA-4 antibody or antigen-binding fragment thereof, anti-PD-L1 antibody or antigen-binding fragment thereof, anti-PD1 antibody or antigen-binding fragment thereof, and anti-Tim-3 antibody or antigen-binding fragment thereof.

In various embodiments, the recombinant orthopoxvirus vector can include at least one transgene encoding encoding at least one interleukin protein. Exemplary interleukin proteins for expression by the orthopoxvirus of the compositions and methods of the invention include but are not limited to IL-1 alpha, IL-1 beta, IL-2, IL-4, IL-7, IL-10, IL-12 p35, IL-12 p40, IL-12 p70, IL-15, IL-18, IL-21, and IL-23.

In various embodiments, recombinant orthopoxvirus vector can include a transgene encoding an interferon. Exemplary interferons for expression by the orthopoxvirus of the compositions and methods of the invention include but are not limited to IFN-alpha, IFN-beta, IFN-delta, IFN-epsilon, IFN-tau, IFN-omega, IFN-zeta, and IFN-gamma.

In various embodiments, the recombinant orthopoxvirus vector can include a transgene encoding a TNF superfamily member protein. Exemplary TNF superfamily member proteins for expression by the orthopoxvirus of the compositions and methods of the invention include but are not limited to TRAIL, Fas ligand, LIGHT (TNFSF-14), TNF-alpha, and 4-1BB ligand.

In various embodiments, the recombinant orthopoxvirus vector can include a transgene encoding a cytokine. Exemplary cytokines for expression by the orthopoxvirus of the compositions and methods of the invention include but are not limited to GM-CSF, Flt3 ligand, CD40 ligand, anti-TGF-beta, anti-VEGF-R2, and cGAS (guanyl adenylate cyclase).

In various embodiments, the recombinant orthopoxvirus vector can include a transgene encoding a tumor-associated antigen. Exemplary tumor-associated antigens for expression by the orthopoxvirus of the compositions and methods of the invention include but are not limited to CD19, CD33, EpCAM, CEA, PSMA, EGFRvIII, CD133, EGFR, CDH19, ENPP3, DLL3, MSLN, ROR1, HER2, HLAA2, EpHA2, EpHA3, MCSP, CSPG4, NG2, RON, FLT3, BCMA, CD20, FAPα, FRα, CA-9, PDGFRα, PDGFRβ, FSP1, S100A4, ADAM12m, RET, MET, FGFR, INSR, NTRK, MAGE-A3, NY-ESO-1, one or more human papillomavirus (HPV) proteins, E6 and E7 proteins of HPV16, E6 and E7 proteins of HPV18, brachyury, or prostatic acid phosphatase, or one or more fragments thereof. Additional examples of tumor-associated antigens for use in conjunction with the compositions and methods described herein include, but are not limited to, those listed in tables 3-30.

Methods of Treatment

Pharmaceutical Composition, Administration, and Doses

Therapeutic compositions containing recombinant orthopoxvirus vectors of the invention can be prepared using methods known in the art. For example, such compositions can be prepared using, e.g., physiologically acceptable carriers, excipients or stabilizers (Remington's Pharmaceutical Sciences 16th edition, Osol, A. Ed. (1980); incorporated herein by reference), and in a desired form, e.g., in the form of lyophilized formulations or aqueous solutions.

To induce oncolysis, kill cells, inhibit growth, inhibit metastases, decrease tumor size and otherwise reverse or reduce the malignant phenotype of tumor cells, using the methods and compositions of the present invention, one may contact a tumor with the modified orthopoxvirus, e.g., by administration of the orthopoxvirus to a patient having cancer by way of, for instance, one or more of the routes of administration described herein. The route of administration may vary with the location and nature of the cancer, and may include, e.g., intradermal, transdermal, parenteral, intravenous, intramuscular, intranasal, subcutaneous, regional (e.g., in the proximity of a tumor, particularly with the vasculature or adjacent vasculature of a tumor), percutaneous, intratracheal, intraperitoneal, intraarterial, intravesical, intratumoral, inhalation, perfusion, lavage, and oral administration and formulation.

The term "intravascular" is understood to refer to delivery into the vasculature of a patient, meaning into, within, or in a vessel or vessels of the patient. In certain embodiments, the administration is into a vessel considered to be a vein (intravenous), while in others administration is into a vessel considered to be an artery. Veins include, but are not limited to, the internal jugular vein, a peripheral vein, a coronary vein, a hepatic vein, the portal vein, great saphenous vein, the pulmonary vein, superior vena cava, inferior vena cava, a gastric vein, a splenic vein, inferior mesenteric vein, superior mesenteric vein, cephalic vein, and/or femoral vein. Arteries include, but are not limited to, coronary artery, pulmonary artery, brachial artery, internal carotid artery, aortic arch, femoral artery, peripheral artery, and/or ciliary artery. It is contemplated that delivery may be through or to an arteriole or capillary.

Intratumoral injection, or injection directly into the tumor vasculature is specifically contemplated for discrete, solid, accessible tumors. Local, regional or systemic administration also may be appropriate. The viral particles may advantageously be contacted by administering multiple injections to the tumor, spaced, for example, at approximately 1 cm intervals. In the case of surgical intervention, the present invention may be used preoperatively, such as to render an inoperable tumor subject to resection. Continuous administration also may be applied where appropriate, for example, by implanting a catheter into a tumor or into tumor vasculature. Such continuous perfusion may take place, for example, for a period of from about 1-2 hours, to about 2-6 hours, to about 6-12 hours, or about 12-24 hours following the initiation of treatment. Generally, the dose of the therapeutic composition via continuous perfusion may be equivalent to that given by a single or multiple injections, adjusted over a period of time during which the perfusion occurs. It is further contemplated that limb perfusion may be used to administer therapeutic compositions of the present invention, particularly in the treatment of melanomas and sarcomas.

Treatment regimens may vary, and often depend on tumor type, tumor location, disease progression, and health and age of the patient. Certain types of tumor will require more aggressive treatment, while at the same time, certain patients cannot tolerate more taxing protocols. The clinician will be best suited to make such decisions based on the known efficacy and toxicity (if any) of the therapeutic formulations. In certain embodiments, the tumor being treated may not, at least initially, be resectable. Treatments with the therapeutic agent of the disclosure may increase the resectability of the tumor due to shrinkage at the margins or by elimination of certain particularly invasive portions. Following treatments, resection may be possible. Additional treatments subsequent to resection will serve to eliminate microscopic residual disease at the tumor site.

The treatments may include various "unit doses." Unit dose is defined as containing a predetermined-quantity of the therapeutic composition. The quantity to be administered, and the particular route and formulation, are within the skill of those in the clinical arts. A unit dose need not be administered as a single injection but may comprise continuous infusion over a set period of time. Unit dose of the present invention may conveniently be described in terms of plaque forming units (pfu) for a viral construct. Unit doses may range from $10^3$, $10^4$, $10^5$, $10^6$, $10^7$, $10^8$, $10^9$, $10^{10}$, $10^{11}$, $10^{12}$, to $10^{13}$ pfu and higher. Additionally or alternatively, depending on the kind of virus and the titer attainable, one may deliver 1 to 100, 10 to 50, 100-1000, or up to about or at least about $1\times10^4$, $1\times10^5$, $1\times10^6$, $1\times10^7$, $1\times10^8$, $1\times10^9$, $1\times10^{10}$, $1\times10^{11}$, $1\times10^{12}$, $1\times10^{13}$, $1\times10^{14}$, or $1\times10^{15}$ or higher infectious viral particles (vp), including all values and ranges there between, to the tumor or tumor site.

Another method of delivery of the recombinant orthopoxvirus genome disclosed herein to cancer or tumor cells may be via intratumoral injection. However, the pharmaceutical compositions disclosed herein may alternatively be administered parenterally, intravenously, intradermally, intramuscularly, transdennally or even intraperitoneally as described in U.S. Pat. Nos. 5,543,158; 5,641,515 and 5,399,363 (each specifically incorporated herein by reference in its entirety). Injection of nucleic acid constructs may be delivered by syringe or any other method used for injection of a solution, as long as the expression construct can pass through the particular gauge of needle required for injection. An exemplary needleless injection system that may be used for the administration of recombinant orthopoxviruses described herein is exemplified in U.S. Pat. No. 5,846,233. This system features a nozzle defining an ampule chamber for holding the solution and an energy device for pushing the solution out of the nozzle to the site of delivery. Another exemplary syringe system is one that permits multiple injections of predetermined quantities of a solution precisely at any depth (U.S. Pat. No. 5,846,225).

Mixtures of the viral particles or nucleic acids described herein may be prepared in water suitably mixed with one or more excipients, carriers, or diluents. Dispersions may also be prepared in glycerol, liquid polyethylene glycols, and mixtures thereof and in oils. Under ordinary conditions of storage and use, these preparations may contain a preservative to prevent the growth of microorganisms. The pharmaceutical forms suitable for injectable use include sterile aqueous solutions or dispersions and sterile powders for the extemporaneous preparation of sterile injectable solutions or dispersions (U.S. Pat. No. 5,466,468, specifically incorporated herein by reference in its entirety). In all cases the form may be sterile and may be fluid to the extent that easy syringability exists. It may be stable under the conditions of manufacture and storage and must be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

For parenteral administration in an aqueous solution, for example, the solution may be suitably buffered if necessary and the liquid diluent first rendered isotonic with sufficient saline or glucose. These particular aqueous solutions are especially suitable for intravenous, intramuscular, subcutaneous, intratumoral and intraperitoneal administration. In this connection, sterile aqueous media that can be employed will be known to those of skill in the art in light of the present disclosure. For example, one dosage may be dissolved in 1 ml of isotonic NaCl solution and either added to 1000 ml of hypodermoclysis fluid or injected at the proposed site of infusion. Some variation in dosage will necessarily occur depending on the condition of the subject being treated. The person responsible for administration will, in any event, determine the appropriate dose for the individual subject. Moreover, for human administration, preparations should meet sterility, pyrogenicity, general safety, and purity standards as required by FDA Office of Biologics standards.

As used herein, "carrier" includes any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Except insofar as any conventional media or agent is incompatible with the active ingredient, its use in the therapeutic compositions is contemplated. Supplementary active ingredients can also be incorporated into the compositions. The phrase "pharmaceutically acceptable" or "pharmacologically-acceptable" refers to molecular entities and compositions that do not produce an allergic or similar untoward reaction when administered to a human. The preparation of an aqueous composition that contains a protein as an active ingredient is well understood in the art. Typically, such compositions are prepared as injectables, either as liquid solutions or suspensions; solid forms suitable for solution in, or suspension in, liquid prior to injection can also be prepared.

Cancer

The recombinant orthopoxvirus disclosed herein can be administered to a mammalian subject, such as a human, suffering from a cell proliferation disorder, such as cancer, e.g., to kill cancer cells directly by oncolysis and/or to enhance the effectiveness of the adaptive immune response against the target cancer cells. In some embodiments, the cell proliferation disorder is a cancer, such as leukemia, lymphoma, liver cancer, bone cancer, lung cancer, brain cancer, bladder cancer, gastrointestinal cancer, breast cancer, cardiac cancer, cervical cancer, uterine cancer, head and neck cancer, gallbladder cancer, laryngeal cancer, lip and oral cavity cancer, ocular cancer, melanoma, pancreatic cancer, prostate cancer, colorectal cancer, testicular cancer, or throat cancer. In particular cases, the cell proliferation disorder may be a cancer selected from the group consisting of acute lymphoblastic leukemia (ALL), acute myeloid leukemia (AML), chronic lymphocytic leukemia (CLL), chronic myelogenous leukemia (CML), adrenocortical carcinoma, AIDS-related lymphoma, primary CNS lymphoma, anal cancer, appendix cancer, astrocytoma, atypical teratoid/rhabdoid tumor, basal cell carcinoma, bile duct cancer, extrahepatic cancer, ewing sarcoma family, osteosarcoma and malignant fibrous histiocytoma, central nervous system embryonal tumors, central nervous system germ cell tumors, craniopharyngioma, ependymoma, bronchial tumors, burkitt lymphoma, carcinoid tumor, primary lymphoma, chordoma, chronic myeloproliferative neoplasms, colon cancer, extrahepatic bile duct cancer, ductal carcinoma in situ (DCIS), endometrial cancer, ependymoma, esophageal cancer, esthesioneuroblastoma, extracranial germ cell tumor, extragonadal germ cell tumor, fallopian tube cancer, fibrous histiocytoma of bone, gastrointestinal carcinoid tumor, gastrointestinal stromal tumors (GIST), testicular germ cell tumor, gestational trophoblastic disease, glioma, childhood brain stem glioma, hairy cell leukemia, hepatocellular cancer, langerhans cell histiocytosis, hodgkin lymphoma, hypopharyngeal cancer, islet cell tumors, pancreatic neuroendocrine tumors, wilms tumor and other childhood kidney tumors, langerhans cell histiocytosis, small cell lung cancer, cutaneous T-cell lymphoma, intraocular melanoma, merkel cell carcinoma, mesothelioma, metastatic squamous neck cancer, midline tract carcinoma, multiple endocrine neoplasia syndromes, multiple myeloma/plasma cell neoplasm, myelodysplastic syndromes, nasal cavity and paranasal sinus cancer, nasopharyngeal cancer, neuroblastoma, non-hodgkin lymphoma (NHL), non-small cell lung cancer (NSCLC), epithelial ovarian cancer, germ cell ovarian cancer, low malignant potential ovarian cancer, pancreatic neuroendocrine tumors, papillomatosis, paraganglioma, paranasal sinus and nasal cavity cancer, parathyroid cancer, penile cancer, pharyngeal cancer, pheochromocytoma, pituitary tumor, pleuropulmonary blastoma, primary peritoneal cancer, rectal cancer, retinoblastoma, rhabdomyosarcoma, salivary gland cancer, kaposi sarcoma, rhabdomyosarcoma, sézary syndrome, small intestine cancer, soft tissue sarcoma, throat cancer, thymoma and thymic carcinoma, thyroid cancer, transitional cell cancer of the renal pelvis and ureter, urethral cancer, endometrial uterine cancer, uterine sarcoma, vaginal cancer, vulvar cancer, and Waldenström macroglobulinemia.

A physician having ordinary skill in the art can readily determine an effective amount of the recombinant orthopoxvirus vector for administration to a mammalian subject (e.g., a human) in need thereof. For example, a physician may start prescribing doses of recombinant orthopoxvirus vector at levels lower than that required in order to achieve the desired therapeutic effect and gradually increase the dosage until the desired effect is achieved. Alternatively, a physician may begin a treatment regimen by administering a dose of recombinant orthopoxvirus vector and subsequently administer progressively lower doses until a therapeutic effect is achieved (e.g., a reduction in the volume of one or more tumors). In general, a suitable daily dose of a recombinant orthopoxvirus vector of the invention will be an amount of the recombinant orthopoxvirus vector which is the lowest dose effective to produce a therapeutic effect. A daily dose of a therapeutic composition of the recombinant orthopoxvirus vector of the invention may be administered as a single dose or as two, three, four, five, six or more doses administered separately at appropriate intervals throughout the day, week, month, or year, optionally, in unit dosage forms. While it is possible for the recombinant orthopoxvirus vector of the invention to be administered alone, it may also be administered as a pharmaceutical formulation in combination with excipients, carriers, and optionally, additional therapeutic agents.

Recombinant orthopoxvirus vectors of the invention can be monitored for their ability to attenuate the progression of a cell proliferation disease, such as cancer, by any of a variety of methods known in the art. For instance, a physician may monitor the response of a mammalian subject (e.g., a human) to treatment with recombinant orthopoxvirus vector of the invention by analyzing the volume of one or more tumors in the patient. Alternatively, a physician may monitor the responsiveness of a subject (e.g., a human) t to treatment with recombinant orthopoxvirus vector of the invention by analyzing the T-reg cell population in the lymph of a particular subject. For instance, a physician may withdraw a sample from a mammalian subject (e.g., a human) and determine the quantity or density of cancer cells using established procedures, such as fluorescence activated cell sorting. A finding that the quantity of cancer cells in the sample has decreased (e.g., by 1%, 2%, 3%, 4%, 5%, 6%, 7%, 8%, 9%, 10%, 20%, 30%, 40%, 50%, 60%, 70%, 80%, 90%, 95%, 96%, 97%, 98%, 99%, or more) relative to the quantity of cancer cells in a sample obtained from the subject prior to administration of the recombinant orthopoxvirus may be an indication that the orthopoxvirus administration is effectively treating the cancer.

Combination Therapy

In various embodiments, the recombinant orthopoxvirus may be co-administered with other cancer therapeutics. Furthermore, in various embodiments, the recombinant orthopoxviruses described herein are administered in conjunction with other cancer treatment therapies, e.g., radiotherapy, chemotherapy, surgery, and/or immunotherapy. In some aspects of this invention, the recombinant orthopoxvirus described herein are administered in conjunction with checkpoint inhibitors. In various embodiments, the recombinant orthopoxvirus may be administered in conjunction with treatment with another immunoncology product. The recombinant orthopoxviruses of the present invention and other therapies or therapeutic agents can be administered simultaneously or sequentially by the same or different routes of administration. The determination of the identity and amount of therapeutic agent(s) for use in the methods of the present invention can be readily made by ordinarily skilled medical practitioners using standard techniques known in the art.

The recombinant orthopoxvirus vectors described herein may be administered with one or more additional agents, such as an immune checkpoint inhibitor. For instance, the recombinant orthopoxvirus vector can be administered simultaneously with, admixed with, or administered separately from an immune checkpoint inhibitor. Exemplary immune checkpoint inhibitors for use in conjunction with the compositions and methods of the invention include but are not limited to OX40 ligand, ICOS ligand, anti-CD47 antibody or antigen-binding fragment thereof, anti-CD40/CD40L antibody or antigen-binding fragment thereof, anti-Lag3 antibody or antigen-binding fragment thereof, anti-CTLA-4 antibody or antigen-binding fragment thereof, anti-PD-L1 antibody or antigen-binding fragment thereof, anti-PD1 antibody or antigen-binding fragment thereof, and anti-Tim-3 antibody or antigen-binding fragment thereof.

Additionally or alternatively, a vector of the invention can be administered simultaneously with, admixed with, or administered separately from an interleukin (IL). For instance, the recombinant orthopoxvirus vector can be administered simultaneously with, admixed with, or administered separately from an interleukin. Exemplary interleukins for use in conjunction with the compositions and methods of the invention include but are not limited to IL-1 alpha, IL-1 beta, IL-2, IL-4, IL-7, IL-10, IL-12 p35, IL-12 p40, IL-12 p70, IL-15, IL-18, IL-21, and IL-23.

Additionally or alternatively, a vector of the invention can be administered simultaneously with, admixed with, or administered separately from an interferon. For instance, the recombinant orthopoxvirus vector can be administered simultaneously with, admixed with, or administered separately from an interferon. Exemplary interferons for use in conjunction with the compositions and methods of the invention include but are not limited to IFN-alpha, IFN-beta, IFN-delta, IFN-epsilon, IFN-tau, IFN-omega, IFN-zeta, and IFN-gamma.

Additionally or alternatively, a vector of the invention can be administered simultaneously with, admixed with, or administered separately from a TNF superfamily member protein. For instance, the recombinant orthopoxvirus vector can be administered simultaneously with, admixed with, or administered separately from a TNF superfamily member protein. Exemplary TNF superfamily member proteins for use in conjunction with the compositions and methods of the invention include but are not limited to TRAIL, Fas ligand, LIGHT (TNFSF-14), TNF-alpha, and 4-1BB ligand.

Additionally or alternatively, a vector of the invention can be administered simultaneously with, admixed with, or administered separately from a cytokine. For instance, the recombinant orthopoxvirus vector can be administered simultaneously with, admixed with, or administered separately from a cytokine. Exemplary cytokines for use in conjunction with the compositions and methods of the invention includes but are not limited to GM-CSF, Flt3 ligand, CD40 ligand, anti-TGF-beta, anti-VEGF-R2, and cGAS (guanyl adenylate cyclase).

TABLE 3

| Ovarian cancer | | | |
|---|---|---|---|
| No. | Tumor-associated antigen | Reported immunogenic epitopes | Sources |
| 1 | Kallikrein 4 | FLGYLILGV (SEQ ID NO: 210); SVSESDTIRSISIAS (SEQ ID NO: 211); LLANGRMPTVLQCVN (SEQ ID NO: 212); and RMPTVLQCVNVSVVS (SEQ ID NO: 213) | Wilkinson et al. Cancer Immunol. Immunother. 61(2): 169-79 (2012). Hural et al. J. Immunol. 169(1): 557-65 (2002). |
| 2 | PBF | CTACRWKKACQR (SEQ ID NO: 214) | Tsukahara et al. Cancer Res. 64(15): 5442-8 (2004). |
| 3 | PRAME | VLDGLDVLL (SEQ ID NO: 215); SLYSFPEPEA (SEQ ID NO: 216); ALYVDSLFFL (SEQ ID NO: 217); SLLQHLIGL (SEQ ID NO: 218); and LYVDSLFFL (SEQ ID NO: 219) | Kessler et al. J. Exp. Med. 193(1): 73-88 (2001). Ikeda et al. Immunity 6(2): 199-208 (1997). |
| 4 | WT1 | TSEKRPFMCAY (SEQ ID NO: 220); CMTWNQMNL (SEQ ID NO: 221); LSHLQMHSRKH (SEQ ID NO: 222); KRYFKLSHLQMHSRKH (SEQ ID NO: 223); and KRYFKLSHLQMHSRKH (SEQ ID NO: 223) | Asemissen et al. Clin. Cancer Res. 12(24): 7476-82 (2006) Ohminami et al. Blood. 95(1): 286-93 (2000). Guo et al. Blood. 106(4): 1415-8 2005). Lin et al. J. Immunother. 36(3): 159-70 (2013). Fujiki et al. J. Immunother. 30(3): 282-93 (2007). |
| 5 | HSDL1 | CYMEAVAL (SEQ ID NO: 224) | Wick et al. Clin. Cancer Res. 20(5): 1125-34 (2014). |
| 6 | Mesothelin | SLLFLLFSL (SEQ ID NO: 225) VLPLTVAEV (SEQ ID NO: 226) ALQGGGPPY (SEQ ID NO: 227) LYPKARLAF (SEQ ID NO: 228) AFLPWHRLF (SEQ ID NO: 229) | Hassan et al. Appl. Immunohistochem. Mol. Morphol. 13(3): 243-7 (2005). Thomas et al J Exp Med. 2004 Aug 2; 200(3): 297-306. |
| 7 | NY-ESO-1 | HLA-A2-restricted peptide p157-165 (SLLMWITQC (SEQ ID NO: 230)), HLA-Cw3-restricted p92-100 (LAMP-FATPM (SEQ ID NO: 231)) and HLA-Cw6-restricted p80-88 (ARGPESRLL (SEQ ID NO: 232)) SLLMWITQC (SEQ ID NO: 230) MLMAQEALAFL (SEQ ID NO: 233) YLAMPFATPME (SEQ ID NO: 234) ASGPGGGAPR (SEQ ID NO: 235) LAAQERRVPR (SEQ ID NO: 236) TVSGNILTIR (SEQ ID NO: 237) APRGPHGGAASGL (SEQ ID NO: 238) | Jager et al. Proc. Natl. Acad. Scie. U.S.A. 103(39): 14453-8 (2006). Gnjatic et al. PNAS Sep. 26, 2000 vol. 97 no. 20 p. 10919 Jager et al. J Exp Med. 187(2): 265-70 (1998). Chen et al. J Immunol. 165(2): 948-55 (2000). Valmori et al. Cancer Res. 60(16): 4499-506 (2000). Aarnoudse et al. Int J Cancer. 82(3): 442-8 (1999). Eikawa et al. Int J Cancer. 132(2): 345-54 (2013). Wang et al. J Immunol. 161(7): 3598-606 (1998). Matsuzaki et al. Cancer Immunol Immunother. 57(8)1185-95 (2008). Ebert et al. Cancer Res. 69(3): 1046-54 (2009). Eikawa et al. Int J Cancer. 132(2): 345-54 (2013). |

TABLE 3-continued

| Ovarian cancer | | | |
|---|---|---|---|
| No. | Tumor-associated antigen | Reported immunogenic epitopes | Sources |
| | | MPFATPMEAEL (SEQ ID NO: 239)<br>KEFTVSGNILTI (SEQ ID NO: 240)<br>MPFATPMEA (SEQ ID NO: 241)<br>FATPMEAEL (SEQ ID NO: 242)<br>FATPMEAELAR (SEQ ID NO: 243)<br>LAMPFATPM (SEQ ID NO: 231)<br>ARGPESRLL (SEQ ID NO: 232)<br>SLLMWITQCFLPVF (SEQ ID NO: 244)<br>LLEFYLAMPFATPMEAEL-ARRSLAQ (SEQ ID NO: 245)<br>EFYLAMPFATPM (SEQ ID NO: 246)<br>PGVLLKEFTVSGNILTIRL-TAADHR (SEQ ID NO: 247)<br>RLLEFYLAMPFA (SEQ ID NO: 248)<br>QGAMLAAQERRVPRAAE-VPR (SEQ ID NO: 249)<br>PFATPMEAELARR (SEQ ID NO: 250)<br>PGVLLKEFTVSGNILTIRLT (SEQ ID NO: 251)<br>VLLKEFTVSG (SEQ ID NO: 252)<br>AADHRQLQLSISSCLQQL (SEQ ID NO: 253)<br>LKEFTVSGNILTIRL (SEQ ID NO: 254)<br>PGVLLKEFTVSGNILTIRL-TAADHR (SEQ ID NO: 247)<br>LLEFYLAMPFATPMEAEL-ARRSLAQ (SEQ ID NO: 245)<br>KEFTVSGNILT (SEQ ID NO: 255)<br>LLEFYLAMPFATPM (SEQ ID NO: 256)<br>AGATGGRGPRGAGA (SEQ ID NO: 257) | Knights et al. Cancer Immunol Immunother. 58(3): 325-38 (2009).<br>Jager et al. Cancer Immun. 2: 12 (2002).<br>Zeng et al. Proc Natl Acad Sci USA. 98(7): 3964-9 (2001).<br>Mandic et al. J Immunol. 174(3): 1751-9 (2005).<br>Chen et al. Proc Natl Acad Sci USA. 101(25): 9363-8 (2004).<br>Ayyoub et al. Clin Cancer Res. 16(18): 4607-15 (2010).<br>Slager et al. J Immunol. 172(8): 5095-102 (2004).<br>Mizote et al. Vaccine. 28(32): 5338-46 (2010).<br>Jager et al. J Exp Med. 191(4): 625-30 (2000).<br>Zarour et al. Cancer Res. 60(17): 4946-52 (2000).<br>Zeng et at. J Immunol. 165(2): 1153-9(2000).<br>Bioley et al. Clin Cancer Res. 15(13): 4467-74 (2009).<br>Zarour et al. Cancer Res. 62(1): 213-8 (2002).<br>Hasegawa et al. Clin Cancer Res. 12(6): 1921-7 (2006). |
| 8 | CEA | TYYRPGVNLSLSC (SEQ ID NO: 258) | Galanis et al. Cancer Res. 70(3): 875-82 (2010). |
| | | EIIYPNASLLIQN (SEQ ID NO: 259) | Bast et al. Am. J. Obstet. Gynecol. 149(5): 553-9 (1984). |
| | | YACFVSNLATGRNNS (SEQ ID NO: 260) | Crosti et al. J Immunol. 176(8): 5093-9 (2006). |
| | | LWWVNNQSLPVSP (SEQ ID NO: 261) | Kobayashi et al. Clin Cancer Res. 8(10): 3219-25 (2002). |
| | | LWWVNNQSLPVSP (SEQ ID NO: 261) | Campi et al. Cancer Res. 63(23): 8481-6 (2003). |
| | | LWWVNNQSLPVSP (SEQ ID NO: 261) | Bakker et al. Int J Cancer. 62(1): 97-102 (1995). |
| | | EIIYPNASLLIQN (SEQ ID NO: 259) | Tsai et al. J Immunol. 158(4): 1796-802 (1997). |
| | | NSIVKSITVSASG (SEQ ID NO: 262) | Kawakami et al. J Immunol. 154(8): 3961-8 (1995). |
| | | KTWGQYWQV (SEQ ID NO: 263) | Cox et al. Science. 264(5159): 716-9 (1994). |
| | | (A)MLGTHTMEV (SEQ ID NO: 264) | Kawakami et al. J Immunol. 154(8): 3961-8 (1995). |
| | | ITDQVPFSV (SEQ ID NO: 265) | Kawakami et al. J Immunol. 161(12): 6985-92 (1998). |
| | | YLEPGPVTA (SEQ ID NO: 266) | Skipper et al. J Immunol. 157(11): 5027-33 (1996). |

TABLE 3-continued

| Ovarian cancer | | | |
|---|---|---|---|
| No. | Tumor-associated antigen | Reported immunogenic epitopes | Sources |
| | | LLDGTATLRL (SEQ ID NO: 267)<br>VLYRYGSFSV (SEQ ID NO: 268)<br>SLADTNSLAV (SEQ ID NO: 269)<br>RLMKQDFSV (SEQ ID NO: 270)<br>RLPRIFCSC (SEQ ID NO: 271)<br>LIYRRRLMK (SEQ ID NO: 272)<br>ALLAVGATK (SEQ ID NO: 273)<br>IALNFPGSQK (SEQ ID NO: 274)<br>RSYVPLAHR (SEQ ID NO: 275) | Michaux et al. J Immunol. 192(4): 1962-71 (2014). |
| 9 | p53 | VVPCEPPEV (SEQ ID NO: 276) | Hung et al. Immunol. Rev. 222:43-69 (2008). |
| 10 | Her2/Neu | HLYQGCQVV (SEQ ID NO: 277)<br>YLVPQQGFFC (SEQ ID NO: 278)<br>PLQPEQLQV (SEQ ID NO: 279)<br>TLEEITGYL (SEQ ID NO: 280)<br>ALIHHNTHL (SEQ ID NO: 281)<br>PLTSIISAV (SEQ ID NO: 282)<br>VLRENTSPK (SEQ ID NO: 283)<br>TYLPTNASL (SEQ ID NO: 284) | Nakatsuka et al. Mod. Pathol. 19(6): 804-814 (2006).<br>Pils et al. Br. J Cancer 96(3): 485-91 (2007).<br>Scardino et al. Eur J Immunol. 31(11): 3261-70 (2001).<br>Scardino et al. J Immunol. 168(11): 5900-6 (2002).<br>Kawashima et al. Cancer Res. 59(2): 431-5 (1999).<br>Okugawa et al. Eur J Immunol. 30(11): 3338-46 (2000). |
| 11 | EpCAM | RYQLDPKFI (SEQ ID NO: 285) | Spizzo et al. Gynecol. Oncol. 103(2): 483-8 (2006).<br>Tajima et al. Tissue Antigens. 64(6): 650-9 (2004). |
| 12 | CA125 | ILFTINFTI (SEQ ID NO: 286)<br>VLFTINFTI (SEQ ID NO: 287)<br>TLNFTITNL (SEQ ID NO: 288)<br>VLQGLLKPL (SEQ ID NO: 289)<br>VLQGLLRPV (SEQ ID NO: 290)<br>RLDPKSPGV (SEQ ID NO: 291)<br>QLYWELSKL (SEQ ID NO: 292)<br>KLTRGIVEL (SEQ ID NO: 293)<br>QLTNGITEL (SEQ ID NO: 294)<br>QLTHNITEL (SEQ ID NO: 295)<br>TLDRNSLYV (SEQ ID NO: 296) | Bast et al. Cancer 116(12): 2850-2853 (2010). |
| 13 | Folate receptor α | FLLSLALML (SEQ ID NO: 297)<br>NLGPWIQQV (SEQ ID NO: 298) | Bagnoli et al. Gynecol. Oncol. 88: S140-4 (2003).<br>Pampeno et al. (2016) High-ranking In Silico epitopes [determined by 3 algorithms: BISMAS, IEDB, RANKPEP] unpublished |

TABLE 3-continued

| Ovarian cancer | | | |
|---|---|---|---|
| No. | Tumor-associated antigen | Reported immunogenic epitopes | Sources |
| 14 | Sperm protein 17 | ILDSSEEDK (SEQ ID NO: 299) | Chiriva-Inernati et al. J. Immunother. 31(8): 693-703 (2008). |
| 15 | TADG-12 | YLPKSWTIQV (SEQ ID NO: 300)<br>WIHEQMERDLKT (SEQ ID NO: 301) | Bellone et al. Cancer 115(4): 800-11 (2009).<br>Underwood et al. BBA Mol. Basis of Disease. 1502(3): 337-350 (2000). |
| 16 | MUC-16 | ILFTINFTI (SEQ ID NO: 286)<br>VLFTINFTI (SEQ ID NO: 287)<br>TLNFTITNL (SEQ ID NO: 288)<br>VLQGLLKPL (SEQ ID NO: 289)<br>VLQGLLRPV (SEQ ID NO: 290)<br>RLDPKSPGV (SEQ ID NO: 291)<br>QLYWELSKL (SEQ ID NO: 292)<br>KLTRGIVEL (SEQ ID NO: 293)<br>QLTNGITEL (SEQ ID NO: 294)<br>QLTHNITEL (SEQ ID NO: 295)<br>TLDRNSLYV (SEQ ID NO: 296) | Chekmasova et al. Clin. Cancer Res. 16(14): 3594-606 (2010). |
| 17 | L1CAM | LLANAYIYV (SEQ ID NO: 302)<br>YLLCKAFGA (SEQ ID NO: 303)<br>KLSPYVHYT (SEQ ID NO: 304) | Hong et al. J. Immunother. 37(2): 93-104 (2014).<br>Pampeno et al. (2016) High-ranking In Silico epitopes [determined by 3 algorithms: BISMAS, IEDB, RANKPEP] unpublished |
| 18 | Mannan-MUC-1 | PDTRPAPGSTAPPAHGV TSA (SEQ ID NO: 305)<br>STAPPVHNV (SEQ ID NO: 306)<br>LLLLTVLTV (SEQ ID NO: 307)<br>PGSTAPPAHGVT (SEQ ID NO: 308) | Loveland et al. Clin. Cancer Res. 12(3 Pt 1): 869-77 (2006).<br>Godelaine et al. Cancer Immunol Immunother. 56(6): 753-9 (2007).<br>Ma et al. Int J Cancer. 129(10): 2427-34 (2011).<br>Wen et al. Cancer Sci. 102(8): 1455-61 (2011).<br>Jerome et al. J Immunol. 151(3): 1654-62 (1993).<br>Brossart et al. Blood. 93(12): 4309-17 (1999).<br>Hiltbold et al. Cancer Res. 58(22): 5066-70 (1998). |
| 19 | HERV-K-MEL | MLAVISCAV (SEQ ID NO: 309) | Schiavetti et al. Cancer Res. 62(19): 5510-6 (2002). |
| 20 | KK-LC-1 | RQKRILVNL (SEQ ID NO: 310) | Fukuyama et al. Cancer Res. 66(9): 4922-8 (2006). |
| 21 | KM-HN-1 | NYNNFYRFL (SEQ ID NO: 311)<br>EYSKECLKEF (SEQ ID NO: 312)<br>EYLSLSDKI (SEQ ID NO: 313) | Fukuyama et al. Cancer Res. 66(9): 4922-8 (2006).<br>Monji et al. Clin Cancer Res. 10(19 Pt 1): 6047-57 (2004). |
| 22 | LAGE-1 | MLMAQEALAFL (SEQ ID NO: 233)<br>SLLMWITQC (SEQ ID NO: 230)<br>LAAQERRVPR (SEQ ID NO: 236)<br>ELVRRILSR (SEQ ID NO: 314) | Aarnoudse et al. Int J Cancer. 82(3): 442-8 (1999).<br>Rimoldi et al. J Immunol. 165(12): 7253-61 (2000).<br>Wang et al. J Immunol. 161(7): 3598-606 (1998).<br>Sun et al. Cancer Immunol Immunother. 55(6): 644-52 (2006). |

TABLE 3-continued

| Ovarian cancer | | | |
|---|---|---|---|
| No. | Tumor-associated antigen | Reported immunogenic epitopes | Sources |
| | | APRGVRMAV (SEQ ID NO: 315) SLLMWITQCFLPVF (SEQ ID NO: 244) QGAMLAAQERRVPRAA EVP-R (SEQ ID NO: 249) AADHRQLQLSISSCLQQL (SEQ ID NO: 253) CLSRRPWKRSWSAGSCP G-MPHL (SEQ ID NO: 316) ILSRDAAPLPRPG (SEQ ID NO: 317) AGATGGRGPRGAGA (SEQ ID NO: 257) | Slager et al. Cancer Gene Ther. 11(3): 227-36 (2004). Zeng et al. Proc Natl Acad Sci USA. 98(7): 3964-9 (2001). Slager et al. J Immunol. 172(8): 5095-102 (2004). Jager et al. J Exp Med. 191(4): 625-30 (2000). Slager et al. J Immunol. 170(3): 1490-7 (2003). Wang et al. Immunity. 20(1): 107-18 (2004). Hasegawa et al. Clin Cancer Res. 12(6): 1921-7 (2006). |
| 23 | MAGE-A4 | EVDPASNTY (SEQ ID NO: 318) GVYDGREHTV (SEQ ID NO: 319) NYKRCFPVI (SEQ ID NO: 320) SESLICMIF (SEQ ID NO: 321) | Kobayashi et al. Tissue Antigens. 62(5): 426-32 (2003). Duffour et al. Eur J Immunol. 29(10): 3329-37 (1999). Miyahara et al. Clin Cancer Res. 11(15): 5581-9 (2005). Ottaviani et al. Cancer Immunol Immunother. 55(7): 867-72 (2006) Zang et al. Tissue Antigens. 60(5): 365-71 (2002). |
| 24 | Sp17 | ILDSSEEDK (SEQ ID NO: 299) | Chiriva-Internati et al. Int J Cancer. 107(5): 863-5 (2003). |
| 25 | SSX-4 | INKTSGPKRGKHAWTHR LRE (SEQ ID NO: 322) YFSKKEWEKMKSSEKIV YVY (SEQ ID NO: 323) MKLNYEVMTKLGFKVT LPPF (SEQ ID NO: 324) KHAWTHRLRERKQLVV YEEI (SEQ ID NO: 325) LGFKVTLPPFMRSKRAA DFH (SEQ ID NO: 326) KSSEKIVYVYMKLNYEV MTK (SEQ ID NO: 327) KHAWTHRLRERKQLVV YEEI (SEQ ID NO: 325) | Ayyoub et al. Clin Immunol. 114(1): 70-8 (2005). Valmori et al. Clin Cancer Res. 12(2): 398-404 (2006). |
| 26 | TAG-1 | SLGWLFLLL (SEQ ID NO: 328) LSRLSNRLL (SEQ ID NO: 329) | Adair et al. J Immunother. 31(1): 7-17 (2008). |
| 27 | TAG-2 | LSRLSNRLL (SEQ ID NO: 329) | Adair et al. J Immunother. 31(1): 7-17 (2008). |

TABLE 4

| Breast cancer | | | |
|---|---|---|---|
| No. | Tumor-associated antigen | Reported immunogenic epitopes | Sources |
| 1 | ENAH(hMena) | TMNGSKSPV (SEQ ID NO: 330) | Di Modugno et al. Int. J. Cancer. 109(6): 909-18 (2004). |
| 2 | mammaglobin-A | PLLENVISK (SEQ ID NO: 331) | Jaramillo et al. Int. J. Cancer. 102(5): 499-506 (2002). |
| 3 | NY-BR-1 | SLSKILDTV (SEQ ID NO: 332) | Wang et al. Cancer Res. 66(13): 6826-33 (2006). |

TABLE 4-continued

| Breast cancer | | | |
|---|---|---|---|
| No. | Tumor-associated antigen | Reported immunogenic epitopes | Sources |
| 4 | EpCAM | RYQLDPKFI (SEQ ID NO: 285) | Gastl et al. Lancet 356(9246): 1981-2 (2000). Tajima, 2004 |
| 5 | NY-ESO-1 | HLA-A2-restricted peptide p157-165 (SLLMWITQC (SEQ ID NO: 230)), HLA-Cw3-restricted p92-100 (LAMP-FATPM (SEQ ID NO: 231)) and HLA-Cw6-restricted p80-88 (ARGPESRLL (SEQ ID NO: 232)) SLLMWITQC (SEQ ID NO: 230) MLMAQEALAFL (SEQ ID NO: 233) YLAMPFATPME (SEQ ID NO: 234) ASGPGGGAPR (SEQ ID NO: 235) LAAQERRVPR (SEQ ID NO: 236) TVSGNILTIR (SEQ ID NO: 237) APRGPHGGAASGL (SEQ ID NO: 238) MPFATPMEAEL (SEQ ID NO: 239) KEFTVSGNILTI (SEQ ID NO: 240) MPFATPMEA (SEQ ID NO: 241) FATPMEAEL (SEQ ID NO: 242) FATPMEAELAR (SEQ ID NO: 243) LAMPFATPM (SEQ ID NO: 231) ARGPESRLL (SEQ ID NO: 232) SLLMWITQCFLPVF (SEQ ID NO: 244) LLEFYLAMPFATPMEAE L-ARRSLAQ (SEQ ID NO: 245) EFYLAMPFATPM (SEQ ID NO: 246) PGVLLICEFTVSGNILTIR L-TAADHR (SEQ ID NO: 247) RLLEFYLAMPFA (SEQ ID NO: 248) QGAMLAAQERRVPRAA E-VPR (SEQ ID NO: 249) PFATPMEAELARR (SEQ ID NO: 250) PGVLLKEFTVSGNILTIR LT (SEQ ID NO: 251) VLLKEFTVSG (SEQ ID NO: 252) AADHRQLQLSISSCLQQL (SEQ ID NO: 253) LKEFTVSGNILTIRL (SEQ ID NO: 254) PGVLLKEFTVSGNILTIR L-TAADHR (SEQ ID NO: 247) LLEFYLAMPFATPMEAE L-ARRSLAQ (SEQ ID NO: 245) KEFTVSGNILT (SEQ ID NO: 255) | Jager et al. Proc. Natl. Acad. Scie. U.S.A. 103(39): 14453-8 (2006). Gnjatic et al. PNAS Sep. 26, 2000 vol. 97 no. 20 p. 10919 Jager et al. J Exp Med. 187(2): 265-70 (1998). Chen et al. J Immunol. 165(2): 948-55 (2000). Valmori et al. Cancer Res. 60(16): 4499-506 (2000). Aarnoudse et al. Int J Cancer. 82(3): 442-8 (1999). Eikawa et al. Int J Cancer. 132(2): 345-54 (2013). Wang et al. J Immunol. 161(7): 3598-606 (1998). Matsuzaki et al. Cancer Immunol Immunother. 57(8)1185-95 (2008). Ebert et al. Cancer Res. 69(3): 1046-54 (2009). Eikawa et al. Int J Cancer. 132(2): 345-54 (2013). Knights et al. Cancer Immunol Immunother. 58(3): 325-38 (2009). Jäger et al. Cancer Immun. 2: 12 (2002). Zeng et al. Proc Natl Acad Sci USA. 98(7): 3964-9 (2001). Mandic et al. J Immunol. 174(3): 1751-9 (2005). Chen et al. Proc Natl Acad Sci USA. 101(25): 9363-8 (2004). Ayyoub et al. Clin Cancer Res. 16(18): 4607-15 (2010). Slager et al. J Immunol. 172(8): 5095-102 (2004). Mizote et al. Vaccine. 28(32): 5338-46 (2010). Jager et al. J Exp Med. 191(4): 625-30 (2000). Zarour et al. Cancer Res. 60(17): 4946-52 (2000). Zeng et al. J Immunol. 165(2): 1153-9 (2000). Bioley et al. Clin Cancer Res. 15(13): 4467-74 (2009) Zarour et al. Cancer Res. 62(1): 213-8 (2002). Hasegawa et al. Clin Cancer Res. 12(6): 1921-7 (2006). |

TABLE 4-continued

Breast cancer

| No. | Tumor-associated antigen | Reported immunogenic epitopes | Sources |
|---|---|---|---|
| | | LLEFYLAMPFATPM (SEQ ID NO: 256)<br>AGATGGRGPRGAGA (SEQ ID NO: 257) | |
| 6 | BAGE-1 | AARAVFLAL (SEQ ID NO: 333) | Boel et al. Immunity. 2(2): 167-75 (1995). |
| 7 | HERV-K-MEL | MLAVISCAV (SEQ ID NO: 309) | Schiavetti et al. Cancer Res. 62(19): 5510-6 (2002). |
| 8 | KK-LC-1 | RQKRILVNL (SEQ ID NO: 310) | Fukuyama et al. Cancer Res. 66(9): 4922-8 (2006). |
| 9 | KM-HN-1 | NYNNFYRFL (SEQ ID NO: 311)<br>EYSKECLKEF (SEQ ID NO: 312)<br>EYLSLSDKI (SEQ ID NO: 313) | Fukuyama et al. Cancer Res. 66(9): 4922-8 (2006).<br>Monji et al. Clin Cancer Res. 10(18 Pt 1): 6047-57 (2004). |
| 10 | LAGE-1 | MLMAQEALAFL (SEQ ID NO: 233)<br>SLLMWITQC (SEQ ID NO: 230)<br>LAAQERRVPR (SEQ ID NO: 236)<br>ELVRRILSR (SEQ ID NO: 314)<br>APRGVRMAV (SEQ ID NO: 315)<br>SLLMWITQCFLPVF (SEQ ID NO: 244)<br>QGAMLAAQERRVPRAA EVP-R (SEQ ID NO: 249)<br>AADHRQLQLSISSCLQQL (SEQ ID NO: 253)<br>CLSRRPWICRSWSAGSCP G-MPHL (SEQ ID NO: 316)<br>ILSRDAAPLPRPG (SEQ ID NO: 317)<br>AGATGGRGPRGAGA (SEQ ID NO: 257) | Aarnoudse et al. Int J Cancer. 82(3): 442-8 (1999).<br>Rimoldi et al. J Immunol. 165(12): 7253-61 (2000).<br>Wang et al. J Immunol. 161(7): 3598-606 (1998).<br>Sun et al. Cancer Immunol Immunother. 55(6): 644-52 (2006).<br>Slager et al. Cancer Gene Ther. 11(3): 227-36 (2004).<br>Zeng et al. Proc Natl Acad Sci USA. 98(7): 3964-9 (2001).<br>Slager et al. J Immunol. 172(8): 5095-102 (2004).<br>Jager et al. J Exp Med. 191(4): 625-30 (2000).<br>Slager et al. J Immunol. 170(3): 1490-7(2003).<br>Wang et al. Immunity. 20(1): 107-18 (2004).<br>Hasegawa et al. Clin Cancer Res. 12(6): 1921-7 (2006). |
| 11 | MAGE-A1 | EADPTGHSY (SEQ ID NO: 334)<br>KVLEYVIKV (SEQ ID NO: 335)<br>SLFRAVITK (SEQ ID NO: 336)<br>EVYDGREHSA (SEQ ID NO: 337)<br>RVRFFFPSL (SEQ ID NO: 338)<br>EADPTGHSY (SEQ ID NO: 334)<br>REPVTKAEML (SEQ ID NO: 339)<br>KEADPTGHSY (SEQ ID NO: 340)<br>DPARYEFLW (SEQ ID NO: 341)<br>ITKKVADLVGF (SEQ ID NO: 342)<br>SAFPTTINF (SEQ ID NO: 343)<br>SAYGEPRKL (SEQ ID NO: 344)<br>RVRFFFPSL (SEQ ID NO: 338)<br>TSCILESLFRAVITK (SEQ ID NO: 345)<br>PRALAETSYVKVLEY (SEQ ID NO: 346) | Traversari et al. J Exp Med. 176(5): 1453-7 (1992).<br>Ottaviani et al. Cancer Immunol Immunother. 54(12): 1214-20 (2005).<br>Pascolo et al. Cancer Res. 61(10): 4072-7 (2001).<br>Chaux et al. J Immunol. 163(5): 2928-36 (1999).<br>Luiten et al. Tissue Anitgens. 55(2): 49-52 (2000).<br>Luiten et al. Tissue Antigens. 56(1): 77-81 (2000).<br>Tanzarella et al. Cancer Res. 59(11): 2668-74 (1999).<br>Stroobant et al. Eur J Immunol. 42(6): 1417-28 (2012).<br>Corbière et al. Tissue Antigens. 63(5): 453-7 (2004).<br>Goodyear et al. Cancer Immunol Immunother. 60(12): 1751-61 (2011).<br>van der Bruggen et al. Eur J Immunol. 24(9): 2134-40 (1994).<br>Wang et al. Cancer Immunol Immunother. 56(6): 807-18 (2007).<br>Chaux et al. J Exp Med. 189(5): 767-78 (1999).<br>Chaux et al. Eur J Immunol. 31(6): 1910-6 (2001). |

TABLE 4-continued

| Breast cancer | | | |
|---|---|---|---|
| No. | Tumor-associated antigen | Reported immunogenic epitopes | Sources |
| | | FLLLKYRAREPVTKAE (SEQ ID NO: 347)<br>EYVIKVSARVRF (SEQ ID NO: 348) | |
| 12 | MAGE-A2 | YLQLVFGIEV (SEQ ID NO: 349)<br>EYLQLVFGI (SEQ ID NO: 350)<br>REPVTKAEML (SEQ ID NO: 339)<br>EGDCAPEEK (SEQ ID NO: 351)<br>LLKYRAREPVTKAE (SEQ ID NO: 352) | Kawashima et al. Hum Immunol. 59(1): 1-14 (1998).<br>Tahara et al. Clin Cancer Res. 5(8): 2236-41 (1999).<br>Tanzarella et al. Cancer Res. 59(11): 2668-74 (1999).<br>Breckpot et al. J Immunol. 172(4): 2232-7 (2004).<br>Chaux et al. J Exp Med. 89(5): 767-78 (1999). |
| 13 | mucink | PDTRPAPGSTAPPAHGV TSA (SEQ ID NO: 305) | Jerome et al. J Immunol. 151(3): 1654-62 (1993). |
| 14 | Sp17 | ILDSSEEDK (SEQ ID NO: 299) | Chiriva-Internati et al. Int J Cancer. 107(5): 863-5 (2003). |
| 15 | SSX-2 | KASEKIFYV (SEQ ID NO: 353)<br>EKIQKAFDDIAKYFSK (SEQ ID NO: 354)<br>FGRLQGISPKI (SEQ ID NO: 355)<br>WEKMKASEKIFYVYMK RK (SEQ ID NO: 356)<br>KIFYVYMKRKYEAMT (SEQ ID NO: 357)<br>KIFYVYMKRKYEAM (SEQ ID NO: 358) | Ayyoub et al. J Immunol. 168(4): 1717-22 (2002).<br>Ayyoub et al. J Immunol. 172(11): 7206-11 (2004).<br>Neumann et al. Cancer Immunol Immunother. 60(9): 1333-46 (2011).<br>Ayyoub et al. Clin Immunol. 114(1): 70-8 (2005).<br>Neumann et al. Int J Cancer. 112(4): 661-8 (2004).<br>Ayyoub et al. J Clin Invest. 113(8): 1225-33 (2004). |
| 16 | TAG-1 | SLGWLFLLL (SEQ ID NO: 328)<br>LSRLSNRLL (SEQ ID NO: 329) | Adair et al. J Immunother. 31(1): 7-17 (2008). |
| 17 | TAG-2 | LSRLSNRLL (SEQ ID NO: 329) | Adair et al. J Immunother. 31(1): 7-17 (2008). |
| 18 | TRAG-3 | CEFHACWPAFTVLGE (SEQ ID NO: 359) | Janjic et al. J Immunol. 177(4): 2717-27 (2006). |
| 19 | Her2/Neu | HLYQGCQVV (SEQ ID NO: 277)<br>YLVPQQGFFC (SEQ ID NO: 278)<br>PLQPEQLQV (SEQ ID NO: 279)<br>TLEEITGYL (SEQ ID NO: 280)<br>ALIHHNTHL (SEQ ID NO: 281)<br>PLTSIISAV (SEQ ID NO: 282)<br>VLRENTSPK (SEQ ID NO: 283)<br>TYLPTNASL (SEQ ID NO: 284) | Nakatsuka et al. Mod. Pathol. 19(6): 804-814 (2006).<br>Pils et al. Br. J. Cancer 96(3): 485-91 (2007).<br>Scardino et al. Eur J Immunol. 31(11): 3261-70 (2001).<br>Scardino et al. J Immunol. 168(11): 5900-6 (2002).<br>Kawashima et al. Cancer Res. 59(2): 431-5 (1999).<br>Okugawa et al. Eur J Immunol. 30(11): 3338-46 (2000). |
| 20 | c-myc | | Reuschenbach et al. Cancer Immunol. Immunother. 58: 1535-1544 (2009) |
| 21 | cyclin B1 | | Reuschenbach et al. Cancer Immunol. Immunother. 58: 1535-1544 (2009) |
| 22 | MUC1 | | Reuschenbach et al. Cancer Immunol. Immunother. 58: 1535-1544 (2009) |

TABLE 4-continued

| No. | Tumor-associated antigen | Reported immunogenic epitopes | Sources |
|---|---|---|---|
| Breast cancer | | | |
| 23 | p53 | VVPCEPPEV (SEQ ID NO: 276) | Hung et al. Immunol. Rev. 222:43-69 (2008). http://cancerimmunity.org/peptide/mutations/ |
| 24 | p62 | | Reuschenbach et al. Cancer Immunol. Immunother. 58: 1535-1544 (2009) |
| 25 | Survivin | | Reuschenbach et al. Cancer Immunol. Immunother. 58: 1535-1544 (2009) |

TABLE 5

| No. | Tumor-associated antigen | Reported immunogenic epitopes | Sources |
|---|---|---|---|
| Testicular cancer | | | |
| 1 | CD45 | KFLDALISL (SEQ ID NO: 360) | Tomita et al. Cancer Sci. 102(4): 697-705 (2011). |
| 2 | DKK1 | ALGGHPLLGV (SEQ ID NO: 361) | Qian et al. Blood. (5): 1587-94 (2007). |
| 3 | PRAME | VLDGLDVLL (SEQ ID NO: 215), SLYSFPEPEA (SEQ ID NO: 216), ALYVDSLFFL (SEQ ID NO: 217), SLLQHLIGL (SEQ ID NO: 218), LYVDSLFFL (SEQ ID NO: 219) | Kessler et al. J Exp Med. 193(1): 73-88 (2001). Ikeda et al. Immunity 6(2): 199-208 (1997). |
| 4 | RU2AS | LPRWPPPQL (SEQ ID NO: 362) | Van Den Eynde et al. J. Exp. Med. 190(12): 1793-800 (1999). |
| 5 | Telomerase | ILAKFLHWL (SEQ ID NO: 363); RLVDDFLLV (SEQ ID NO: 364); RPGLLGASVLGLDDI (SEQ ID NO: 365); and LTDLQPYMRQFVAHL (SEQ ID NO: 366) | Vonderheide et al. Immunity 10(6): 673-9 (1999). Miney et al. Proc. Natl. Acad. Sci. U.S.A. 97(9): 4796-801 (2000). Schroers et al. Cancer Res. 62(9): 2600-5 (2002). Schroers et al. Clin. Cancer Res. 9(13): 4743-55 (2003). |

TABLE 6

| No. | Tumor-associated antigen | Reported immunogenic epitopes | Sources |
|---|---|---|---|
| Pancreatic cancer | | | |
| 1 | ENAH (hMena) | TMNGSKSPV (SEQ ID NO: 330) | Di Modugno et al. Int. J. Cancer. 109(6): 909-18 (2004). |
| 2 | PBF | CTACRWKKACQR (SEQ ID NO: 214) | Tsukahara et al. Cancer Res. 64(15): 5442-8 (2004). |
| 3 | K-ras | VVVGAVGVG (SEQ ID NO: 367) | Gjertsen et al. Int. J. Cancer. 72(5): 784-90 (1997). |

TABLE 6 -continued

| Pancreatic cancer | | | |
|---|---|---|---|
| No. | Tumor-associated antigen | Reported immunogenic epitopes | Sources |
| 4 | Mesothelin | SLLFLLFSL (SEQ ID NO: 225) VLPLTVAEV (SEQ ID NO: 226) ALQGGGPPY (SEQ ID NO: 227) LYPKARLAF (SEQ ID NO: 228) AFLPWHRLF (SEQ ID NO: 229) | Le et al. Clin. Cancer Res. 18(3): 858-68 (2012). Hassan et al. Appl. Immunohistochem. Mol. Morphol. 13(3): 243-7 (2005). Thomas et al J Exp Med. 2004 Aug. 2; 200(3): 297-306. |
| 5 | mucink | PDTRPAPGSTAPPAHGVTSA (SEQ ID NO: 305) | Jerome et al. J Immunol. 151(3): 1654-62 (1993). |

TABLE 7

| Liver cancer | | | |
|---|---|---|---|
| No. | Tumor-associated antigen | Reported immunogenic epitopes | Sources |
| 1 | G250/ MN/ CAIX | HLSTAFAR (SEQ ID NO: 368); KIFGSLAFL (SEQ ID NO: 369); IISAVVGIL (SEQ ID NO: 370); ALCRWGLLL (SEQ ID NO: 371); ILHNGAYSL (SEQ ID NO: 372); RLLQETELV (SEQ ID NO: 373); VVKGVVFGI (SEQ ID NO: 374); and YMIMVKCWMI (SEQ ID NO: 375) | Vissers et al. Cancer Res. 59(21): 5554-9 (1999). Fisk et al. J Exp Med. 181(6): 2109-17 (1995). Brossart et al. Cancer Res. 58(4): 732-6 (1998). Kawashima et al. Hum Immunol. 59(1): 1-14 (1998). Rongcun et al. J Immunol. 163(2): 1037-44 (1999). |
| 2 | Hepsin | SLLSGDWVL (SEQ ID NO: 376); GLQLGVQAV (SEQ ID NO: 377); and PLTEYIQPV (SEQ ID NO: 378) | Guo et al. Scand J Immunol. 78(3): 248-57 (2013). |
| 3 | Intestinal carboxyl esterase | SPRWWPTCL (SEQ ID NO: 379) | Ronsin et al. J Immunol. 163(1): 483-90 (1999). |
| 4 | alpha-foetoprotein | GVALQTMKQ (SEQ ID NO: 380); FMNICFIYEI (SEQ ID NO: 381); and QLAVSVILRV (SEQ ID NO: 382) | Butterfield et al. Cancer Res. 59(13): 3134-42 (1999). Pichard et al. J Immunother. 31(3): 246-53 (2008) Alisa et al. Clin. Cancer Res. 11(18): 6686-94 (2005). |
| 5 | M-CSF | LPAVVGLSPGEQEY (SEQ ID NO: 383) | Probst-Kepper et al. J Exp Med. 193(10): 1189-98 (2001). |
| 6 | PBF | CTACRWKKACQR (SEQ ID NO: 214) | Tsukahara et al. Cancer Res. 64(15): 5442-8 (2004). |
| 7 | PSMA | NYARTEDFF (SEQ ID NO: 384) | Horiguchi et al. Clin Cancer Res. 8(12): 3885-92 (2002). |

TABLE 7-continued

| Liver cancer | | | |
|---|---|---|---|
| No. | Tumor-associated antigen | Reported immunogenic epitopes | Sources |
| 8 | NY-ESO-1 | HLA-A2-restricted peptide p157-165 (SLLMWITQC (SEQ ID NO: 230)), HLA-Cw3-restricted p92-100 (LAMP-FATPM (SEQ ID NO: 231)) and HLA-Cw6-restricted p80-88 (ARGPESRLL (SEQ ID NO: 232))<br>SLLMWITQC (SEQ ID NO: 230)<br>MLMAQEALAFL (SEQ ID NO: 233)<br>YLAMPFATPME (SEQ ID NO: 234)<br>ASGPGGGAPR (SEQ ID NO: 235)<br>LAAQERRVPR (SEQ ID NO: 236)<br>TVSGNILTIR (SEQ ID NO: 237)<br>APRGPHGGAASGL (SEQ ID NO: 238)<br>MPFATPMEAEL (SEQ ID NO: 239)<br>KEFTVSGNILTI (SEQ ID NO: 240)<br>MPFATPMEA (SEQ ID NO: 241)<br>FATPMEAEL (SEQ ID NO: 242)<br>FATPMEAELAR (SEQ ID NO: 243)<br>LAMPFATPM (SEQ ID NO: 231)<br>ARGPESRLL (SEQ ID NO: 232)<br>SLLMWITQCFLPVF (SEQ ID NO: 244)<br>LLEFYLAMPFATPMEAEL-ARRSLAQ (SEQ ID NO: 245)<br>EFYLAMPFATPM (SEQ ID NO: 246)<br>PGVLLKEFTVSGNILTIRL-TAADHR (SEQ ID NO: 247)<br>RLLEFYLAMPFA (SEQ ID NO: 248)<br>QGAMLAAQERRVPRAAE-VPR (SEQ ID NO: 249)<br>PFATPMEAELARR (SEQ ID NO: 250)<br>PGVLLKEFTVSGNILTIRLT (SEQ ID NO: 251)<br>VLLKEFTVSG (SEQ ID NO: 252)<br>AADHRQLQLSISSCLQQL (SEQ ID NO: 253)<br>LKEFTVSGNILTIRL (SEQ ID NO: 254)<br>PGVLLKEFTVSGNILTIRL-TAADHR (SEQ ID NO: 247)<br>LLEFYLAMPFATPMEAEL-ARRSLAQ (SEQ ID NO: 245)<br>KEFTVSGNILT (SEQ ID NO: 255)<br>LLEFYLAMPFATPM (SEQ ID NO: 256)<br>AGATGGRGPRGAGA (SEQ ID NO: 257) | Jager et al. Proc. Natl. Acad. Scie. U.S.A. 103(39): 14453-8 (2006).<br>Gnjatic et al. PNAS Sep. 26, 2000 vol. 97 no. 20 p. 10919<br>Jager et al. J Exp Med. 187(2): 265-70 (1998).<br>Chen et al. J Immunol. 165(2): 948-55 (2000).<br>Valmori et al. Cancer Res. 60(16): 4499-506 (2000).<br>Aarnoudse et al. Int J Cancer. 82(3): 442-8 (1999).<br>Eikawa et al. Int J Cancer. 132(2): 345-54 (2013).<br>Wang et al. J Immunol. 161(7): 3598-606 (1998).<br>Matsuzaki et al. Cancer Immunol Immunother. 57(8)1185-95 (2008).<br>Ebert et al. Cancer Res. 69(3): 1046-54 (2009).<br>Eikawa et al. Int J Cancer. 132(2): 345-54 (2013).<br>Knights et al. Cancer Immunol Immunother. 58(3): 325-38 (2009).<br>Jäger et al. Cancer Immun. 2: 12 (2002).<br>Zeng et al. Proc Natl Acad Sci USA. 98(7): 3964-9 (2001).<br>Mandic et al. J Immunol. 174(3): 1751-9 (2005).<br>Chen et al. Proc Natl Acad Sci USA. 101(25): 9363-8 (2004).<br>Ayyoub et al. Clin Cancer Res. 16(18): 4607-15 (2010).<br>Slager et al. J Immunol. 172(8): 5095-102 (2004).<br>Mizote et al. Vaccine. 28(32): 5338-46 (2010).<br>Jager et al. J Exp Med. 191(4): 625-30 (2000).<br>Zarour et al. Cancer Res. 60(17): 4946-52 (2000).<br>Zeng et al. J Immunol. 165(2): 1153-9 (2000).<br>Bioley et al. Clin Cancer Res. 15(13): 4467-74 (2009).<br>Zarour et al. Cancer Res. 62(1): 213-8 (2002).<br>Hasegawa et al. Clin Cancer Res. 12(6): 1921-7 (2006). |

TABLE 7-continued

| Liver cancer | | | |
|---|---|---|---|
| No. | Tumor-associated antigen | Reported immunogenic epitopes | Sources |
| 9 | LAGE-1 | MLMAQEALAFL (SEQ ID NO: 233)<br>SLLMWITQC (SEQ ID NO: 230)<br>LAAQERRVPR (SEQ ID NO: 236)<br>ELVRRILSR (SEQ ID NO: 314)<br>APRGVRMAV (SEQ ID NO: 315)<br>SLLMWITQCFLPVF (SEQ ID NO: 244)<br>QGAMLAAQERRVPRAAE VP-R (SEQ ID NO: 249)<br>AADHRQLQLSISSCLQQL (SEQ ID NO: 253)<br>CLSRRPWKRSWSAGSCP G-MPHL (SEQ ID NO: 316)<br>ILSRDAAPLPRPG (SEQ ID NO: 317)<br>AGATGGRGPRGAGA (SEQ ID NO: 257) | Aarnoudse et al. Int J Cancer. 82(3): 442-8 (1999).<br>Rimoldi et al. J Immunol. 165(12): 7253-61 (2000).<br>Wang et al. J Immunol. 161(7): 3598-606 (1998).<br>Sun et al. Cancer Immunol Immunother. 55(6): 644-52 (2006).<br>Slager et al. Cancer Gene Ther. 11(3): 227-36 (2004).<br>Zeng et al. Proc Natl Acad Sci USA. 98(7): 3964-9 (2001).<br>Stager et al. J Immunol. 172(8): 5095-102 (2004).<br>Jager et al. J Exp Med. 191(4): 625-30 (2000).<br>Stager et al. J Immunol. 170(3): 1490-7 (2003).<br>Wang et al. Immunity. 20(1): 107-18 (2004).<br>Hasegawa et al. Clin Cancer Res. 12(6): 1921-7 (2006). |
| 10 | HERV-K-MEL | MLAVISCAV (SEQ ID NO: 309) | Schiavetti et al. Cancer Res. 62(19): 5510-6 (2002). |
| 11 | KK-LC-1 | RQKRILVNL (SEQ ID NO: 310) | Fukuyama et al. Cancer Res. 66(9): 4922-8 (2006). |
| 12 | KM-HN-1 | NYNNFYRFL (SEQ ID NO: 311)<br>EYSKECLKEF (SEQ ID NO: 312)<br>EYLSLSDKI (SEQ ID NO: 313) | Fukuyama et al. Cancer Res. 66(9): 4922-8 (2006).<br>Monji et al. Clin Cancer Res. 10(18 Pt 1): 6047-57 (2004). |
| 13 | Sp17 | ILDSSEEDK (SEQ ID NO: 299) | Chiriva-Internati et al. Int J Cancer. 107(5): 863-5 (2003). |
| 14 | c-myc | | Reuschenbach et al. Cancer Immunol. Immunother. 58: 1535-1544 (2009) |
| 15 | cyclin B1 | | Reuschenbach et al. Cancer Immunol. Immunother. 58: 1535-1544 (2009) |
| 16 | p53 | VVPCEPPEV (SEQ ID NO: 276) | Hung et al. Immunol. Rev. 222:43-69 (2008). http://cancerimmunity.org/peptide/mutations/ |
| 17 | p62 | | Reuschenbach et al. Cancer Immunol. Immunother. 58: 1535-1544 (2009) |
| 18 | Survivin | | Reuschenbach et al. Cancer Immunol. Immunother. 58: 1535-1544 (2009) |

TABLE 8

| Colorectal cancer | | | |
|---|---|---|---|
| No. | Tumor-associated antigen | Reported immunogenic epitopes | Sources |
| 1 | ENAH (hMena) | TMNGSKSPV (SEQ ID NO: 330) | Di Modugno et al. Int. J Cancer. 109(6): 909-18 (2004). |
| 2 | Intestinal carboxyl esterase | SPRWWPTCL (SEQ ID NO: 379) | Ronsin et al. J Immunol. 163(1): 483-90 (1999). |

TABLE 8 -continued

Colorectal cancer

| No. | Tumor-associated antigen | Reported immunogenic epitopes | Sources |
|---|---|---|---|
| 3 | CASP-5 | FLIIWQNTM (SEQ ID NO: 385) | Schwitalle et al. Cancer Immun. 4: 14 (2004). |
| 4 | COA-1 | TLYQDDTLTLQAAG (SEQ ID NO: 386) | Maccalli et al. Cancer Res. 63(20): 6735-43 (2003). |
| 5 | OGT | SLYKFSPFPL (SEQ ID NO: 387) | Ripberger. J Clin Immunol. 23(5): 415-23 (2003). |
| 6 | OS-9 | KELEGILLL (SEQ ID NO: 388) | Vigneron et al. Cancer Immun. 2: 9 (2002). |
| 7 | TGF-betaRII | RLSSCVPVA (SEQ ID NO: 389) | Linnebacher et al. Int. J. Cancer. 93(1): 6-11 (2001). |
| 8 | NY-ESO-1 | HLA-A2-restricted peptide p157-165 (SLLMWITQC (SEQ ID NO: 230)), HLA-Cw3-restricted p92-100 (LAMP-FATPM (SEQ ID NO: 231)) and HLA-Cw6-restricted p80-88 (ARGPESRLL (SEQ ID NO: 232))<br>SLLMWITQC (SEQ ID NO: 230)<br>MLMAQEALAFL (SEQ ID NO: 233)<br>YLAMPFATPME (SEQ ID NO: 234)<br>ASGPGGGAPR (SEQ ID NO: 235)<br>LAAQERRVPR (SEQ ID NO: 236)<br>TVSGNILTIR (SEQ ID NO: 237)<br>APRGPHGGAASGL (SEQ ID NO: 238)<br>MPFATPMEAEL (SEQ ID NO: 239)<br>KEFTVSGNILTI (SEQ ID NO: 240)<br>MPFATPMEA (SEQ ID NO: 241)<br>FATPMEAEL (SEQ ID NO: 242)<br>FATPMEAELAR (SEQ ID NO: 243)<br>LAMPFATPM (SEQ ID NO: 231)<br>ARGPESRLL (SEQ ID NO: 232)<br>SLLMWITQCFLPVF (SEQ ID NO: 244)<br>LLEFYLAMPFATPMEAEL-ARRSLAQ (SEQ ID NO: 245)<br>EFYLAMPFATPM (SEQ ID NO: 246)<br>PGVLLKEFTVSGNILTLRL-TAADHR (SEQ ID NO: 247)<br>RLLEFYLAMPFA (SEQ ID NO: 248)<br>QGAMLAAQERRVPRAAE-VPR (SEQ ID NO: 249)<br>PFATPMEAELARR (SEQ ID NO: 250)<br>PGVLLKEFTVSGNILTIRLT (SEQ ID NO: 251)<br>VLLKEFTVSG (SEQ ID NO: 252)<br>AADHRQLQLSISSCLQQL (SEQ ID NO: 253) | Jager et al. Proc. Natl. Acad. Scie. U.S.A. 103(39): 14453-8 (2006).<br>Gnjatic et al. PNAS Sep. 26, 2000 vol. 97 no. 20 p. 10919<br>Jager et al. J Exp Med. 187(2): 265-70 (1998).<br>Chen et al. J Immunol. 165(2): 948-55 (2000).<br>Valmori et al. Cancer Res. 60(16): 4499-506 (2000).<br>Aarnoudse et al. Int J Cancer. 82(3): 442-8 (1999).<br>Eikawa et al. Int J Cancer. 132(2): 345-54 (2013).<br>Wang et al. J Immunol. 161(7): 3598-606 (1998).<br>Matsuzaki et al. Cancer Immunol Immunother. 57(8)1185-95 (2008).<br>Ebert et al. Cancer Res. 69(3): 1046-54 (2009).<br>Eikawa et al. Int J Cancer. 132(2): 345-54 (2013).<br>Knights et al. Cancer Immunol Immunother. 58(3): 325-38 (2009).<br>Jäger et al. Cancer Immun. 2:12 (2002).<br>Zeng et al. Proc Natl Acad Sci USA. 98(7): 3964-9 (2001).<br>Mandic et al. J Immunol. 174(3): 1751-9 (2005).<br>Chen et al. Proc Natl Acad Sci USA. 101(25): 9363-8 (2004).<br>Ayyoub et al. Clin Cancer Res. 16(18): 4607-15 (2010).<br>Slager et al. J Immunol. 172(8): 5095-102 (2004).<br>Mizote et al. Vaccine. 28(32): 5338-46 (2010).<br>Jager et al. J Exp Med. 191(4): 625-30 (2000).<br>Zarour et al. Cancer Res. 60(17): 4946-52 (2000).<br>Zeng et al. J Immunol. 165(2): 1153-9 (2000).<br>Bioley et al. Clin Cancer Res. 15 (13): 4467-74 (2009).<br>Zarour et al. Cancer Res. 62(1): 213-8 (2002).<br>Hasegawa et al. Clin Cancer Res. 12(6): 1921-7 (2006). |

TABLE 8 -continued

| Colorectal cancer | | | |
|---|---|---|---|
| No. | Tumor-associated antigen | Reported immunogenic epitopes | Sources |
| | | LKEFTVSGNILTIRL (SEQ ID NO: 254)<br>PGVLLKEFTVSGNILTIRL-TAADHR (SEQ ID NO: 247)<br>LLEFYLAMPFATPMEAEL-ARRSLAQ (SEQ ID NO: 245)<br>KEFTVSGNILT (SEQ ID NO: 255)<br>LLEFYLAMPFATPM (SEQ ID NO: 256)<br>AGATGGRGPRGAGA (SEQ ID NO: 257) | |
| 9 | CEA | TYYRPGVNLSLSC (SEQ ID NO: 258)<br>EIIYPNASLLIQN (SEQ ID NO: 259)<br>YACFVSNLATGRNNS (SEQ ID NO: 260)<br>LWWVNNQSLPVSP (SEQ ID NO: 261)<br>LWWVNNQSLPVSP (SEQ ID NO: 261)<br>LWWVNNQSLPVSP (SEQ ID NO: 261)<br>EIIYPNASLLIQN (SEQ ID NO: 259)<br>NSIVKSITVSASG (SEQ ID NO: 262)<br>KTWGQYWQV (SEQ ID NO: 263)<br>(A)MLGTHTMEV (SEQ ID NO: 264)<br>ITDQVPFSV (SEQ ID NO: 265)<br>YLEPGPVTA (SEQ ID NO: 266)<br>LLDGTATLRL (SEQ ID NO: 267)<br>VLYRYGSFSV (SEQ ID NO: 268)<br>SLADTNSLAV (SEQ ID NO: 269)<br>RLMKQDFSV (SEQ ID NO: 270)<br>RLPRIFCSC (SEQ ID NO: 271)<br>LIYRRRLMK (SEQ ID NO: 272)<br>ALLAVGATK (SEQ ID NO: 273)<br>IALNFPGSQK (SEQ ID NO: 274)<br>RSYVPLAHR (SEQ ID NO: 275) | Duffy, Clin. Chem. 47(4): 624-30 (2001).<br>Parkhurst et al. Mol. Ther. 19(3): 620-6 (2011).<br>Galanis et al. Cancer Res. 70(3): 875-82 (2010).<br>Bast et al. Am. J. Obstet. Gynecol. 149(5): 553-9 (1984).<br>Crosti et al. J Immunol. 176(8): 5093-9 (2006).<br>Kobayashi et al. Clin Cancer Res. 8(10): 3219-25 (2002).<br>Campi et al. Cancer Res. 63(23): 8481-6 (2003).<br>Bakker et at. Int J Cancer. 62(1): 97-102 (1995).<br>Tsai et al. J Immunol. 158(4): 1796-802 (1997).<br>Kawakami et al. J Immunol. 154(8): 3961-8 (1995).<br>Cox et al. Science. 264(5159): 716-9 (1994).<br>Kawakami et al. J Immunol. 154(8): 3961-8 (1995).<br>Kawakami et al. J Immunol. 161(12): 6985-92 (1998).<br>Skipper et al. J Immunol. 157(11): 5027-33 (1996).<br>Michaux et al. J Immunol. 192(4): 1962-71 (2014). |
| 10 | HERV-K-MEL | MLAVISCAV (SEQ ID NO: 309) | Schiavetti et al. Cancer Res. 62(19): 5510-6 (2002). |
| 11 | KK-LC-1 | RQKRILVNL (SEQ ID NO: 310) | Fukuyama et al. Cancer Res. 66(9): 4922-8 (2006). |
| 12 | KM-HN-1 | NYNNFYRFL (SEQ ID NO: 311).<br>EYSKECLKEF (SEQ ID NO: 312)<br>EYLSLSDKI (SEQ ID NO: 313) | Fukuyama et al. Cancer Res. 66(9): 4922-8 (2006).<br>Monji et al. Clin Cancer Res. 10(18 Pt 1): 6047-57 (2004). |

TABLE 8 -continued

| Colorectal cancer | | | |
|---|---|---|---|
| No. | Tumor-associated antigen | Reported immunogenic epitopes | Sources |
| 13 | LAGE-1 | MLMAQEALAFL (SEQ ID NO: 233)<br>SLLMWITQC (SEQ ID NO: 230)<br>LAAQERRVPR (SEQ ID NO: 236)<br>ELVRRILSR (SEQ ID NO: 314)<br>APRGVRMAV (SEQ ID NO: 315)<br>SLLMWITQCFLPVF (SEQ ID NO: 244)<br>QGAMLAAQERRVPRAA EVP-R (SEQ ID NO: 249)<br>AADHRQLQLSISSCLQQL (SEQ ID NO: 253)<br>CLSRRPWKRSWSAGSCP G-MPHL (SEQ ID NO: 316)<br>ILSRDAAPLPRPG (SEQ ID NO: 317)<br>AGATGGRGPRGAGA (SEQ ID NO: 257) | Aarnoudse et al. Int J Cancer. 82(3): 442-8 (1999).<br>Rimoldi et al. J Immunol. 165(12): 7253-61 (2000).<br>Wang et al. J Immunol. 161(7): 3598-606 (1998).<br>Sun et at. Cancer Immunol Immunother. 55(6): 644-52 (2006).<br>Slager et al. Cancer Gene Ther. 11(3): 227-36 (2004).<br>Zeng et al. Proc Natl Acad Sci USA. 98(7): 3964-9 (2001).<br>Slager et al. J Immunol. 172(8): 5095-102 (2004).<br>Jager et al. J Exp Med. 191(4): 625-30 (2000).<br>Slager et al. J Immunol. 170(3): 1490-7(2003).<br>Wang et al. Immunity. 20(1): 107-18 (2004).<br>Hasegawa et al. Clin Cancer Res. 12(6): 1921-7 (2006). |
| 14 | MAGE-A2 | YLQLVFGIEV (SEQ ID NO: 349)<br>EYLQLVFGI (SEQ ID NO: 350)<br>REPVTKAEML (SEQ ID NO: 339)<br>EGDCAPEEK (SEQ ID NO: 351)<br>LLKYRAREPVTKAE (SEQ ID NO: 352) | Kawashima et al. Hum Immunol. 59(1): 1-14 (1998).<br>Tahara et al. Clin Cancer Res. 5(8): 2236-41 (1999).<br>Tanzarella et al. Cancer Res. 59(11): 2668-74 (1999).<br>Breckpot et al. J Immunol. 172(4): 2232-7 (2004).<br>Chaux et al. J Exp Med. 89(5): 767-78 (1999). |
| 15 | Sp17 | ILDSSEEDK (SEQ ID NO: 299) | Chiriva-Internati et al. Int J Cancer. 107(5): 863-5 (2003). |
| 16 | TAG-1 | SLGWLFLLL (SEQ ID NO: 328)<br>LSRLSNRLL (SEQ ID NO: 329) | Adair et al. J Immunother. 31(1): 7-17 (2008). |
| 17 | TAG-2 | LSRLSNRLL (SEQ ID NO: 329) | Adair et al. J Immunother. 31(1): 7-17 (2008). |
| 18 | c-myc | | Reuschenbach et al. Cancer Immunol. Immunother. 58: 1535-1544 (2009) |
| 19 | cyclin B1 | | Reuschenbach et al. Cancer Immunol. Immunother. 58: 1535-1544 (2009) |
| 20 | MUC1 | | Reuschenbach et al. Cancer Imnumol. Immunother. 58: 1535-1544 (2009) |
| 21 | p53 | VVPCEPPEV (SEQ ID NO: 276) | Hung et al. Immunol. Rev. 222:43-69 (2008).<br>http://cancerimmunity.org/peptide/mutations/ |
| 22 | p62 | | Reuschenbach et al. Cancer Immunol. Immunother. 58: 1535-1544 (2009) |
| 23 | Survivin | | Reuschenbach et al. Cancer Immunol. Immunother. 58: 1535-1544 (2009) |
| 24 | gp70 | | Castle et al., BMC Genomics 15: 190 (2014) |

TABLE 9

Thyroid cancer

| No. | Tumor-associated antigen | Reported immunogenic epitopes | Sources |
|---|---|---|---|
| 1 | CALCA | VLLQAGSLHA (SEQ ID NO: 390) | El Hage et al. Proc. Natl. Acad. Sci. U.S.A. 105(29): 10119-24 (2008). |
| 2 | NY-ESO-1 | HLA-A2-restricted peptide p157-165 (SLLMWITQC (SEQ ID NO: 230)), HLA-Cw3-restricted p92-100 (LAMP-FATPM (SEQ ID NO: 231)) and HLA-Cw6-restricted p80-88 (ARGPESRLL (SEQ ID NO: 232))<br>SLLMWITQC (SEQ ID NO: 230)<br>MLMAQEALAFL (SEQ ID NO: 233)<br>YLAMPFATPME (SEQ ID NO: 234)<br>ASGPGGGAPR (SEQ ID NO: 235)<br>LAAQERRVPR (SEQ ID NO: 236)<br>TVSGNILTIR (SEQ ID NO: 237)<br>APRGPHGGAASGL (SEQ ID NO: 238)<br>MPFATPMEAEL (SEQ ID NO: 239)<br>KEFTVSGNILTI (SEQ ID NO: 240)<br>MPFATPMEA (SEQ ID NO: 241)<br>FATPMEAEL (SEQ ID NO: 242)<br>FATPMEAELAR(SEQ ID NO: 243)<br>LAMPFATPM (SEQ ID NO: 231)<br>ARGPESRLL (SEQ ID NO: 232)<br>SLLMWITQCFLPVF (SEQ ID NO: 244)<br>LLEFYLAMPFATPMEAEL-ARRSLAQ (SEQ ID NO: 245)<br>EFYLAMPFATPM (SEQ ID NO: 246)<br>PGVLLKEFTVSGNILTIRL-TAADIAR (SEQ ID NO: 247)<br>RLLEFYLAMPFA (SEQ ID NO: 248)<br><br>QGAMLAAQERRVPRAAE-VPR (SEQ ID NO: 249)<br>PFATPMEAELARR (SEQ ID NO: 250)<br>PGVLLKEFTVSGNILTIRLT (SEQ ID NO: 251)<br>VLLKEFTVSG (SEQ ID NO: 252)<br>AADHRQLQLSISSCLQQL (SEQ ID NO: 253)<br>LKEFTVSGNILTIRL (SEQ ID NO: 254)<br>PGVLLKEFTVSGNILTIRL-TAADHR (SEQ ID NO: 247)<br>LLEFYLAMPFATPMEAEL-ARRSLAQ (SEQ ID NO: 245)<br>KEFTVSGNILT (SEQ ID NO: 255)<br>LLEFYLAMPFATPM (SEQ ID NO: 256)<br>AGATGGRGPRGAGA (SEQ ID NO: 257) | Jager et al. Proc. Natl. Acad. Scie. U.S.A. 103(39): 14453-8 (2006).<br>Gnjatic et al. PNAS Sep. 26, 2000 vol. 97 no. 20 p. 10919<br>Jager et al. J Exp Med. 187(2): 265-70 (1998).<br>Chen et al. J Immunol. 165(2): 948-55 (2000).<br>Valmori et al. Cancer Res. 60(16): 4499-506 (2000).<br>Aarnoudse et al. Int J Cancer. 82(3): 442-8 (1999).<br>Eikawa et al. Int J Cancer. 132(2): 345-54 (2013).<br>Wang et al. J Immunol. 161(7): 3598-606 (1998).<br>Matsuzaki et al. Cancer Immunol Immunother. 57(8)1185-95 (2008).<br>Ebert et al. Cancer Res. 69(3): 1046-54 (2009).<br>Eikawa et al. Int J Cancer. 132(2): 345-54 (2013).<br>Knights et al. Cancer Immunol Immunother. 58(3): 325-38 (2009).<br>Jäger et al. Cancer Immun. 2: 12 (2002).<br>Zeng et al. Proc Natl Acad Sci USA. 98(7): 3964-9 (2001).<br>Mandic et al. J Immunol. 174(3): 1751-9 (2005).<br>Chen et al. Proc Natl Acad Sci USA. 101(25): 9363-8 (2004).<br>Ayyoub et al. Clin Cancer Res. 16(18): 4607-15 (2010).<br>Slager et al. J Immunol. 172(8): 5095-102 (2004).<br>Mizote et al. Vaccine. 28(32): 5338-46 (2010).<br>Jager et al. J Exp Med. 191(4): 625-30 (2000).<br>Zarour et al. Cancer Res. 60(17): 4946-52 (2000).<br>Zeng et al. J Immunol. 165(2): 1153-9 (2000).<br>Bioley et al. Clin Cancer Res. 15(13): 4467-74 (2009).<br>Zarour et al. Cancer Res. 62(1): 213-8 (2002).<br>Hasegawa et al. Clin Cancer Res. 12(6): 1921-7 (2006). |

TABLE 9-continued

| Thyroid cancer | | | |
|---|---|---|---|
| No. | Tumor-associated antigen | Reported immunogenic epitopes | Sources |
| 3 | HERV-K-MEL | MLAVISCAV (SEQ ID NO: 309) | Schiavetti et al. Cancer Res. 62(19): 5510-6 (2002). |
| 4 | KK-LC-1 | RQKRILVNL (SEQ ID NO: 310) | Fukuyama et al. Cancer Res. 66(9): 4922-8 (2006). |
| 5 | KM-HN-1 | NYNNFYRFL (SEQ ID NO: 311)<br>EYSKECLKEF (SEQ ID NO: 312)<br>EYLSLSDKI (SEQ ID NO: 313) | Fukuyama et al. Cancer Res. 66(9): 4922-8 (2006).<br>Monji et al. Clin Cancer Res. 10(18 Pt 1): 6047-57 (2004). |
| 6 | LAGE-1 | MLMAQEALAFL (SEQ ID NO: 233)<br>SLLMWITQC (SEQ ID NO: 230)<br>LAAQERRVPR (SEQ ID NO: 236)<br>ELVRRILSR (SEQ ID NO: 314)<br>APRGVRMAV (SEQ ID NO: 315)<br>SLLMWITQCFLPVF (SEQ ID NO: 244)<br>QGAMLAAQERRVPRAAEVP-R (SEQ ID NO: 249)<br>AADHRQLQLSISSCLQQL (SEQ ID NO: 253)<br>CLSRRPWKRSWSAGSCPG-MPHL (SEQ ID NO: 316)<br>ILSRDAAPLPRPG (SEQ ID NO: 317)<br>AGATGGRGPRGAGA (SEQ ID NO: 257) | Aarnoudse et al. Int J Cancer. 82(3): 442-8 (1999).<br>Rimoldi et al. J Immunol. 165(12): 7253-61 (2000).<br>Wang et al. J Immunol. 161(7): 3598-606 (1998).<br>Sun et al. Cancer Immunol Immunother. 55(6): 644-52 (2006).<br>Slager et al. Cancer Gene Ther. 11(3): 227-36 (2004).<br>Zeng et al. Proc Natl Acad Sci USA. 98(7): 3964-9 (2001).<br>Slager et al. J Immunol. 172(8): 5095-102 (2004).<br>Jager et al. J Exp Med. 191(4): 625-30 (2000).<br>Slager et al. J Immunol. 170(3): 1490-7 (2003).<br>Wang et al. Immunity. 20(1): 107-18 (2004).<br>Hasegawa et al. Clin Cancer Res. 12(6): 1921-7 (2006). |
| 7 | Sp17 | ILDSSEEDK (SEQ ID NO: 299) | Chiriva-Internati et al. Int J Cancer. 107(5): 863-5 (2003). |

TABLE 10

| Lung cancer | | | |
|---|---|---|---|
| No. | Tumor-associated antigen | Reported immunogenic epitopes | Sources |
| 1 | CD274 | LLNAFTVTV (SEQ ID NO: 391) | Munir et al. Cancer Res. 73(6): 1764-76 (2013). |
| 2 | mdm-2 | VLFYLGQY (SEQ ID NO: 392) | Asai et al. Cancer Immun. 2: 3 (2002). |
| 3 | alpha-actinin-4 | FIASNGVKLV (SEQ ID NO: 393) | Echchakir et al. Cancer Res. 61(10): 4078-83 (2001). |
| 4 | Elongation factor 2 (squamous cell carcinoma of the lung) | ETVSEQSNV (SEQ ID NO: 394) | Hogan et al. Cancer Res. 58(22): 5144-50 (1998). |
| 5 | ME1(non-small cell lung carcinoma) | FLDEFMEGV (SEQ ID NO: 395) | Karanikas et al. Cancer Res. 61(9): 3718-24 (2001). |

TABLE 10-continued

| Lung cancer | | | |
|---|---|---|---|
| No. | Tumor-associated antigen | Reported immunogenic epitopes | Sources |
| 6 | NFYC (squamous cell carcinoma of the lung) | QQITKTEV (SEQ 1D NO: 396) | Takenoyama et al. Int. J Cancer. 118(8): 1992-7 (2006). |
| 7 | NY-ESO-1 | HLA-A2-restricted peptide p157-165 (SLLMWITQC (SEQ ID NO: 230)), HLA-Cw3-restricted p92-100 LAMP-FATPM (SEQ ID NO: 231)) and HLA-Cw6-restricted p80-88 (ARGPESRLL (SEQ ID NO: 232))<br>SLLMWITQC (SEQ ID NO: 230)<br>MLMAQEALAFL (SEQ ID NO: 233)<br>YLAMPFATPME (SEQ ID NO: 234)<br>ASGPGGGAPR (SEQ ID NO: 235)<br>LAAQERRVPR (SEQ ID NO: 236)<br>TVSGNILTIR (SEQ ID NO: 237)<br>APRGPHGGAASGL (SEQ ID NO: 238)<br>MPFATPMEAEL (SEQ ID NO: 239)<br>KEFTVSGNILTI (SEQ ID NO: 240)<br>MPFATPMEA (SEQ ID NO: 241)<br>FATPMEAEL (SEQ ID NO: 242)<br>FATPMEAELAR (SEQ ID NO: 243)<br>LAMPFATPM (SEQ ID NO: 231)<br>ARGPESRLL (SEQ ID NO: 232)<br>SLLMWITQCFLPVF (SEQ ID NO: 244)<br>LLEFYLAMPFATPMEAE L-ARRSLAQ (SEQ ID NO: 245)<br>EFYLAMPFATPM (SEQ ID NO: 246)<br>PGVLLKEFTVSGNILTIRL -TAADHR (SEQ ID NO: 247)<br>RLLEFYLAMPFA (SEQ ID NO: 248)<br>QGAMLAAQERRVPRAA E-VPR (SEQ ID NO: 249)<br>PFATPMEAELARR (SEQ ID NO: 250)<br>PGVLLKEFTVSGNILTIRLT (SEQ ID NO: 251)<br>VLLKEFTVSG (SEQ ID NO: 252)<br>AADHRQLQLSISSCLQQL (SEQ ID NO: 253)<br>LKEFTVSGNILTIRL (SEQ ID NO: 254)<br>PGVLLKEFTVSGNILTIRL -TAADHR (SEQ ID NO: 247)<br>LLEFYLAMPFATPMEAE L-ARRSLAQ (SEQ ID NO: 245) | Jager et al. Proc. Natl. Acad. Scie. U.S.A. 103(39): 14453-8 (2006).<br>Gnjatic et al. PNAS Sep. 26, 2000 vol. 97 no. 20 p. 10919<br>Jager et al. J Exp Med. 187(2): 265-70 (1998).<br>Chen et al. J Immunol. 165(2): 948-55 (2000).<br>Valmori et al. Cancer Res. 60(16): 4499-506 (2000).<br>Aarnoudse et al. Int J Cancer. 82(3): 442-8 (1999).<br>Eikawa et al. Int J Cancer. 132(2): 345-54 (2013).<br>Wang et al. J Immunol. 161(7): 3598-606 (1998).<br>Matsuzaki et al. Cancer Immunol Immunother. 57(8)1185-95 (2008).<br>Ebert et al. Cancer Res. 69(3): 1046-54 (2009).<br>Eikawa et al. Int J Cancer. 132(2): 345-54 (2013).<br>Knights et al. Cancer Immunol Immunother. 58(3): 325-38 (2009).<br>Jäger et al. Cancer Immun. 2: 12 (2002).<br>Zeng et al. Proc Natl Acad Sci USA. 98(7): 3964-9 (2001).<br>Mandic et al. J Immunol. 174(3): 1751-9 (2005).<br>Chen et al. Proc Natl Acad Sci USA. 101(25): 9363-8 (2004).<br>Ayyoub et al. Clin Cancer Res. 16(18): 4607-15 (2010).<br>Slager et al. J Immunol. 172(8): 5095-102 (2004).<br>Mizote et al. Vaccine. 28(32): 5338-46 (2010).<br>Jager et al. J Exp Med. 191(4): 625-30 (2000).<br>Zarour et al. Cancer Res. 60(17): 4946-52 (2000).<br>Zeng et al. J Immunol. 165(2): 1153-9 (2000).<br>Bioley et al. Clin Cancer Res. 15(13): 4467-74 (2009).<br>Zarour et al. Cancer Res. 62(1): 213-8 (2002).<br>Hasegawa et al. Clin Cancer Res. 12(6): 1921-7 (2006). |

TABLE 10-continued

| Lung cancer | | | |
|---|---|---|---|
| No. | Tumor-associated antigen | Reported immunogenic epitopes | Sources |
| | | KEFTVSGNILT (SEQ ID NO: 255)<br>LLEFYLAMPFATPM (SEQ ID NO: 256)<br>AGATGGRGPRGAGA (SEQ ID NO: 257) | |
| 8 | GAGE-1,2,8 | YRPRPRRY (SEQ ID NO: 397) | Van den Eynde et al. J Exp Med. 182(3): 689-98 (1995). |
| 9 | HERV-K-MEL | MLAVISCAV (SEQ ID NO: 309) | Schiavetti et al. Cancer Res. 62(19): 5510-6 (2002). |
| 10 | KK-LC-1 | RQKRILVNL (SEQ ID NO: 310) | Fukuyama et al. Cancer Res. 66(9): 4922-8 (2006). |
| 11 | KM-HN-1 | NYNNFYRFL (SEQ ID NO: 311)<br>EYSKECLKEF (SEQ ID NO: 312)<br>EYLSLSDKI (SEQ ID NO: 313) | Fukuyama et al. Cancer Res. 66(9): 4922-8 (2006).<br>Monji et al. Clin Cancer Res. 10(18 Pt 1): 6047-57 (2004). |
| 12 | LAGE-1 | MLMAQEALAFL (SEQ ID NO: 233)<br>SLLMWITQC (SEQ ID NO: 230)<br>LAAQERRVPR (SEQ ID NO: 236)<br>ELVRRILSR (SEQ ID NO: 314)<br>APRGVRMAV (SEQ ID NO: 315)<br>SLLMWITQCFLPVF (SEQ ID NO: 244)<br>QGAMLAAQERRVPRAA EVP-R (SEQ ID NO: 249)<br>AADHRQLQLSISSCLQQL (SEQ ID NO: 253)<br>CLSRRPWKRSWSAGSCP G-MPHL (SEQ ID NO: 316)<br>ILSRDAAPLPRPG (SEQ ID NO: 317)<br>AGATGGRGPRGAGA (SEQ ID NO: 257) | Aarnoudse et al. Int J Cancer. 82(3): 442-8 (1999).<br>Rimoldi et al. J Immunol. 165(12): 7253-61 (2000).<br>Wang et al. J Immunol. 161(7): 3598-606 (1998).<br>Sun et al. Cancer Immunol Immunother. 55(6): 644-52 (2006).<br>Slager et al. Cancer Gene Ther. 11(3): 227-36 (2004).<br>Zeng et al. Proc Natl Acad Sci USA. 98(7): 3964-9 (2001).<br>Slager et al. J Immunol. 172(8): 5095-102 (2004).<br>Jager et al. J Exp Med. 191(4): 625-30 (2000).<br>Slager et al. J Immunol. 170(3): 1490-7 (2003).<br>Wang et al. Immunity. 20(1): 107-18 (2004).<br>Hasegawa et al. Clin Cancer Res. 12(6): 1921-7 (2006). |
| 13 | MAGE-A2 | YLQLVFGIEV (SEQ ID NO: 349)<br>EYLQLVFGI (SEQ ID NO: 350)<br>REPVTKAEML (SEQ ID NO: 339)<br>EGDCAPEEK (SEQ ID NO: 351)<br>LLKYRAREPVTKAE (SEQ ID NO: 352) | Kawashima et al. Hum Immunol. 59(1): 1-14 (1998).<br>Tahara et al. Clin Cancer Res. 5(8): 2236-41 (1999).<br>Tanzarella et al. Cancer Res. 59(11): 2668-74 (1999).<br>Breckpot et al. J Immunol. 172(4): 2232-7 (2004).<br>Chaux et al. J Exp Med. 89(5): 767-78 (1999). |
| 14 | MAGE-A6 (squamous cell lung carcinoma) | MVKISGGPR (SEQ ID NO: 398)<br>EVDPIGHVY (SEQ ID NO: 399)<br>REPVTKAEML (SEQ ID NO: 339)<br>EGDCAPEEK (SEQ ID NO: 351)<br>ISGGPRISY (SEQ ID NO: 400)<br>LLKYRAREPVTKAE (SEQ ID NO: 352) | Zorn et al. Eur J Immunol. 29(2): 602-7 (1999).<br>Benlalam et al. J Immunol. 171(11): 6283-9 (2003).<br>Tanzarella et al. Cancer Res. 59(11): 2668-74 (1999).<br>Breckpot et al. J Immunol. 172(4): 2232-7 (2004).<br>Vantomme et al. Cancer Immun. 3: 17 (2003).<br>Chaux et al. J Exp Med. 189(5): 767-78 (1999). |
| 15 | Sp17 | ILDSSEEDK (SEQ ID NO: 299) | Chiriva-Internati et al. Int J Cancer. 107(5): 863-5 (2003). |

TABLE 10-continued

| Lung cancer | | | |
|---|---|---|---|
| No. | Tumor-associated antigen | Reported immunogenic epitopes | Sources |
| 16 | TAG-1 | SLGWLFLLL (SEQ ID NO: 328)<br>LSRLSNRLL (SEQ ID NO: 329) | Adair et al. J Immunother. 31(1): 7-17 (2008). |
| 17 | TAG-2 | LSRLSNRLL (SEQ ID NO: 329) | Adair et al. J Immunother. 31(1): 7-17 (2008). |
| 18 | TRAG-3 | CEFHACWPAFTVLGE (SEQ ID NO: 359) | Janjic et al. J Immunol. 177(4): 2717-27 (2006). |
| 19 | XAGE-1b/GAGED2a (non-small cell lung cancer) | RQKKIRIQL (SEQ ID NO: 401)<br>HLGSRQKKIRIQLRSQ (SEQ ID NO: 402)<br>CATWKVICKSCISQTPG (SEQ ID NO: 403) | Ohue et al. Int J Cancer. 131(5): E649-58 (2012).<br>Shimono et al. Int J Oncol. 30(4): 835-40 (2007). |
| 20 | c-myc | | Reuschenbach et al. Cancer Immunol. Immunother. 58: 1535-1544 (2009) |
| 21 | cyclin B1 | | Reuschenbach et al. Cancer Immunol. Immunother. 58: 1535-1544 (2009) |
| 22 | Her2/Neu | HLYQGCQVV (SEQ ID NO: 277)<br>YLVPQQGFFC (SEQ ID NO: 278)<br>PLQPEQLQV (SEQ ID NO: 279)<br>TLEEITGYL (SEQ ID NO: 280)<br>ALIHHNTHL (SEQ ID NO: 281)<br>PLTSIISAV (SEQ ID NO: 282)<br>VLRENTSPK (SEQ ID NO: 283)<br>TYLPTNASL (SEQ ID NO: 404) | Nakatsuka et al. Mod. Pathol. 19(6): 804-814 (2006).<br>Pils et al. Br. J. Cancer 96(3): 485-91 (2007).<br>Scardino et al. Eur J Immunol. 31(11): 3261-70 (2001).<br>Scardino et al. J Immunol. 168(11): 5900-6 (2002).<br>Kawashima et al. Cancer Res. 59(2): 431-5 (1999).<br>Okugawa et al. Eur J Immunol. 30(11): 3338-46 (2000). |
| 23 | MUC1 | | Reuschenbach et al. Cancer Immunol. Immunother. 58: 1535-1544 (2009) |
| 24 | p53 | VVPCEPPEV (SEQ ID NO: 276) | Hung et al. Immunol. Rev. 222: 43-69 (2008).<br>http://cancerimmunity.org/peptide/mutations/ |
| 25 | p62 | | Reuschenbach et al. Cancer Immunol. Immunother. 58: 1535-1544 (2009) |
| 26 | Survivin | | Reuschenbach et al. Cancer Immunol. Immunother. 58: 1535-1544 (2009) |

TABLE 11

| Prostate cancer | | | |
|---|---|---|---|
| No. | Tumor-associated antigen | Reported immunogenic epitopes | Sources |
| 1 | DKK1 | ALGGHPLLGV (SEQ ID NO: 361) | Qian et al. Blood. 110(5): 1587-94 (2007). |
| 2 | ENAH (hMena) | TMNGSKSPV (SEQ ID NO: 330) | Di Modugno et al. Int. J. Cancer. 109(6): 909-18 (2004). |

TABLE 11-continued

| Prostate cancer | | | |
|---|---|---|---|
| No. | Tumor-associated antigen | Reported immunogenic epitopes | Sources |
| 3 | Kallikrein 4 | FLGYLILGV (SEQ ID NO: 210); SVSESDTIRSISIAS (SEQ ID NO: 211); LLANGRMPTVLQCVN (SEQ ID NO: 212); and RMPTVLQCVNVSVVS (SEQ ID NO: 213) | Wilkinson et al. Cancer Immunol Immunother. 61(2): 169-79 (2012). Hural et al. J. Immunol. 169(1): 557-65 (2002). |
| 4 | PSMA | NYARTEDFF (SEQ ID NO: 384) | Horiguchi et al. Clin Cancer Res. 8(12): 3885-92 (2002). |
| 5 | STEAP1 | MIAVFLPIV (SEQ ID NO: 405) and HQQYFYKIPILVINK (SEQ ID NO: 406) | Rodeberg et al. Clin. Cancer Res. 11(12): 4545-52 (2005). Kobayashi et al. Cancer Res. 67(11): 5498-504 (2007). |
| 6 | PAP | FLFLLFFWL (SEQ ID NO: 407); TLMSAMTNL (SEQ ID NO: 408); and ALDVYNGLL (SEQ ID NO: 409) | Olson et al. Cancer Immunol Immunother. 59(6): 943-53 (2010). |
| 7 | PSA (prostate carcinoma) | FLTPKKLQCV (SEQ ID NO: 410) and VISNDVCAQV (SEQ ID NO: 411) | Correale et al. J Natl. Cancer Inst. 89(4): 293-300 (1997). |
| 8 | NY-ESO-1 | HLA-A2-restricted peptide p157-165 (SLLMWITQC (SEQ ID NO: 230)), HLA-Cw3-restricted p92-100 (LAMP-FATPM (SEQ ID NO: 231)) and HLA-Cw6-restricted p80-88 (ARGPESRLL (SEQ ID NO: 232)) SLLMWITQC (SEQ ID NO: 230) MLMAQEALAFL (SEQ ID NO: 233) YLAMPFATPME (SEQ ID NO: 234) ASGPGGGAPR (SEQ ID NO: 235) LAAQERRVPR (SEQ ID NO: 236) TVSGNILTIR (SEQ ID NO: 237) APRGPHGGAASGL (SEQ ID NO: 238) MPFATPMEAEL (SEQ ID NO: 239) KEFTVSGNILTI (SEQ ID NO: 240) MPFATPMEA (SEQ ID NO: 241) FATPMEAEL (SEQ ID NO: 242) FATPMEAELAR (SEQ ID NO: 243) LAMPFATPM (SEQ ID NO: 231) ARGPESRLL (SEQ ID NO: 232) SLLMWITQCFLPVF (SEQ ID NO: 244) LLEFYLAMPFATPMEAEL-ARRSLAQ (SEQ ID NO: 245) EFYLAMPFATPM (SEQ ID NO: 246) PGVLLKEFTVSGNILTLRL-TAADHR (SEQ ID NO: 247) RLLEFYLAMPFA (SEQ ID NO: 248) | Jager et al. Proc. Natl. Acad. Scie. U.S.A. 103(39): 14453-8 (2006). Gnjatic et al. PNAS Sep. 26, 2000 vol. 97 no. 20 p. 10919 Jager et al. J Exp Med. 187(2): 265-70 (1998). Chen et al. J Immunol. 165(2): 948-55 (2000). Valmori et al. Cancer Res. 60(16): 4499-506 (2000). Aarnoudse et al. Int J Cancer. 82(3): 442-8 (1999). Eikawa et al. Int J Cancer. 132(2): 345-54 (2013). Wang et al. J Immunol. 161(7): 3598-606(1998). Matsuzaki et al. Cancer Immunol Immunother. 57(8)1185-95 (2008). Ebert et al. Cancer Res. 69(3): 1046-54 (2009). Eikawa et al. Int J Cancer. 132(2): 345-54 (2013). Knights et al. Cancer Immunol Immunother. 58(3): 325-38 (2009). Jäger et al. Cancer Immun. 2: 12 (2002). Zeng et al. Proc Natl Acad Sci USA. 98(7): 3964-9 (2001). Mandic et al. J Immunol. 174(3): 1751-9 (2005). Chen et al. Proc Natl Acad Sci USA. 101(25): 9363-8 (2004). Ayyoub et al. Clin Cancer Res. 16(18): 4607-15 (2010). Slager et al. J Immunol. 172(8): 5095-102 (2004). Mizote et al. Vaccine. 28(32): 5338-46 (2010). Jager et al. J Exp Med. 191(4): 625-30 (2000). |

TABLE 11-continued

| Prostate cancer | | | |
|---|---|---|---|
| No. | Tumor-associated antigen | Reported immunogenic epitopes | Sources |
| | | QGAMLAAQERRVPRAAE-VPR (SEQ ID NO: 249) PFATPMEAELARR (SEQ ID NO: 250) PGVLLKEFTVSGNILTIRLT (SEQ ID NO: 251) VLLKEFTVSG (SEQ ID NO: 252) AADHRQLQLSISSCLQQL (SEQ ID NO: 253) LKEFTVSGNILTIRL (SEQ ID NO: 254) PGVLLICEFTVSGNILTIRL-TAADHR (SEQ ID NO: 247) LLEFYLAMPFATPMEAEL-ARRSLAQ (SEQ ID NO: 245) KEFTVSGNILT (SEQ ID NO: 255) LLEFYLAMPFATPM (SEQ ID NO: 256) AGATGGRGPRGAGA (SEQ ID NO: 257) | Zarour et al. Cancer Res. 60(17): 4946-52 (2000). Zeng et al. J Immunol. 165(2): 1153-9 (2000). Bioley et al. Clin Cancer Res. 15(13): 4467-74 (2009). Zarour et al. Cancer Res. 62(1): 213-8 (2002). Hasegawa et al. Clin Cancer Res. 12(6): 1921-7 (2006). |
| 9 | BAGE-1 (non-small cell lung carcinoma) | AARAVFLAL (SEQ ID NO: 333) | Boel et al. Immunity. 2(2): 167-75 (1995). |
| 10 | GAGE-1,2,8 (non-small cell lunch carcinoma) | YRPRPRRY (SEQ ID NO: 397) | Van den Eynde et al. J Exp Med. 182(3): 689-98 (1995). |
| 11 | GAGE-3,4,5,6,7 (lung squamous cell carcinoma and lung adenocarcinoma) | YYWPRPRRY (SEQ ID NO: 412) | De Backer et al. Cancer Res. 59(13): 3157-65 (1999). |
| 12 | HERV-K-MEL | MLAVISCAV (SEQ ID NO: 309) | Schiavetti et al. Cancer Res. 62(19): 5510-6 (2002). |
| 13 | KK-LC-1 | RQKRILVNL (SEQ ID NO: 310) | Fukuyama et al. Cancer Res. 66(9): 4922-8 (2006). |
| 14 | KM-HN-1 | NYNNFYRFL (SEQ ID NO: 311) EYSKECLKEF (SEQ ID NO: 312) EYLSLSDKI (SEQ ID NO: 313) | Fukuyama et al. Cancer Res. 66(9): 4922-8 (2006). Monji et al. Clin Cancer Res. 10(18 Pt 1): 6047-57 (2004). |
| 15 | LAGE-1 | MLMAQEALAFL (SEQ ID NO: 233) SLLMWITQC (SEQ ID NO: 230) LAAQERRVPR (SEQ ID NO: 236) ELVRRILSR (SEQ ID NO: 314) APRGVRMAV (SEQ ID NO: 315) SLLMWITQCFLPVF (SEQ ID NO: 244) QGAMLAAQERRVPRAAEVP-R (SEQ ID NO: 249) AADHRQLQLSISSCLQQL (SEQ ID NO: 253) CLSRRPWKRSWSAGSCPG-MPHL (SEQ ID NO: 316) ILSRDAAPLPRPG (SEQ ID NO: 317) AGATGGRGPRGAGA (SEQ ID NO: 257) | Aarnoudse et al. Int J Cancer. 82(3): 442-8 (1999). Rimoldi et al. J Immunol. 165(12): 7253-61 (2000). Wang et al. J Immunol. 161(7): 3598-606 (1998). Sun et al. Cancer Immunol Immunother. 55(6): 644-52 (2006). Slager et al. Cancer Gene Ther. 11(3): 227-36 (2004). Zeng et al. Proc Natl Acad Sci USA. 98(7): 3964-9(2001). Slager et al. J Immunol. 172(8): 5095-102 (2004). Jager et al. J Exp Med. 191(4): 625-30 (2000). Slager et al. J Immunol. 170(3): 1490-7 (2003). Wang et al. Immunity. 20(1): 107-18 (2004). Hasegawa et al. Clin Cancer Res. 12(6): 1921-7 (2006). |

TABLE 11-continued

| Prostate cancer | | | |
|---|---|---|---|
| No. | Tumor-associated antigen | Reported immunogenic epitopes | Sources |
| 16 | Sp17 | ILDSSEEDK (SEQ ID NO: 299) | Chiriva-Internati et al. Int J Cancer. 107(5): 863-5 (2003). |

TABLE 12

| Kidney cancer | | | |
|---|---|---|---|
| No. | Tumor-associated antigen | Reported immunogenic epitopes | Sources |
| 1 | FGF5 | NTYASPRFK (SEQ ID NO: 413) | Hanada et al. Nature. 427(6971): 252-6 (2004). |
| 2 | Hepsin | SLLSGDWVL (SEQ ID NO: 376); GLQLGVQAV (SEQ ID NO: 377); and PLTEYIQPV (SEQ ID NO: 378) | Guo et al. Scand J Immunol. 78(3): 248-57 (2013). |
| 3 | Intestinal carboxyl esterase | SPRWWPTCL (SEQ ID NO: 379) | Ronsin et al. J Immunol. 163(1): 483-90 (1999). |
| 4 | M-CSF | LPAVVGLSPGEQEY (SEQ ID NO: 383) | Probst-Kepper et al. J Exp Med. 193(10): 1189-98 (2001). |
| 5 | RU2AS | LPRWPPPQL (SEQ ID NO: 362) | Van Den Eynde et al. J. Exp. Med. 190(12): 1793-800 (1999). |
| 6 | hsp70-2 (renal cell carcinoma) | SLFEGIDIYT (SEQ ID NO: 414) | Gaudin et al. J. Immunol. 162(3): 1730-8 (1999). |
| 7 | Mannan-MUC-1 (renal cell carcinoma) | PDTRPAPGSTAPPAHGVTSA (SEQ ID NO: 305) STAPPVHNV (SEQ ID NO: 306) LLLLTVLTV (SEQ ID NO: 307) PGSTAPPAHGVT (SEQ ID NO: 308) | Loveland et al. Clin. Cancer Res. 12(3 Pt 1): 869-77 (2006). Loveland et al. Clin. Cancer Res. 12(3 Pt 1): 869-77 (2006). Godelaine et al. Cancer Immunol Immunother. 56(6): 753-9 (2007). Ma et al. Int J Cancer. 129(10): 2427-34 (2011). Wen et al. Cancer Sci. 102(8): 1455-61 (2011). Jerome et al. J Immunol. 151(3): 1654-62 (1993). Brossart et al. Blood. 93(12): 4309-17 (1999). Hiltbold et al. Cancer Res. 58(22): 5066-70 (1998). |
| 8 | MAGE-A9 (renal cell carcinoma) | ALSVMGVYV (SEQ ID NO: 415) | Oehlrich et al. Int J Cancer. 117(2): 256-64 (2005). |

TABLE 13

| No. | Tumor-associated antigen | Reported immunogenic epitopes | Sources |
|---|---|---|---|
| | | Melanoma | |
| 1 | Hepsin | SLLSGDWVL (SEQ ID NO: 376); GLQLGVQA (SEQ ID NO: 416); and PLTEYIQPV (SEQ ID NO: 378) | Guo et at. Scand J Immunol. 78(3): 248-57 (2013). |
| 2 | ARTC1 | YSVYFNLPADTIYTN (SEQ ID NO: 417) | Wang et al J Immunol. 174(5): 2661-70 (2005). |
| 3 | B-RAF | EDLTVKIGDFGLATEKSR WSGSHQFEQLS (SEQ ID NO: 418) | Sharkey et at. Cancer Res. 64(5): 1595-9 (2004). |
| 4 | beta-catenin | SYLDSGIHF (SEQ ID NO: 419) | Robbins et al. J. Exp. Med. 183(3): 1185-92 (1996). |
| 5 | Cdc27 | FSWAMDLDPKGA (SEQ ID NO: 420) | Wang et al. Science. 284(5418): 1351-4 (1999). |
| 6 | CDK4 | ACDPHSGHFV (SEQ ID NO: 421) | Wölfel et al. Science. 269(5228): 1281-4 (1995). |
| 7 | CDK12 | CILGKLFTK SEQ ID NO: 422) | Robbins et al. Nat Med. 19(6): 747-52. (2013). |
| 8 | CDKN2A | AVCPWTWLR (SEQ ID NO: 423) | Huang et al. J Immunol. 172(10): 6057-64 (2004). |
| 9 | CLPP | ILDKVLVHL SEQ ID NO: 424) | Corbière et al. Cancer Res. 71(4): 1253-62 (2011). |
| 10 | CSNK1A1 | GLFGDIYLA (SEQ ID NO: 425) | Robbins et al. Nat Med. 19(6): 747-52 (2013). |
| 11 | FN1 | MIFEKHGFRRTTPP (SEQ ID NO: 426) | Wang et al. J Exp Med. 195(11): 1397-406 (2003). |
| 12 | GAS7 | SLADEAEVYL (SEQ ID NO: 427) | Robbins, et al. Nat Med. 19(6): 747-52 (2013). |
| 13 | GPNMB | TLDWLLQTPK (SEQ ID NO: 428) | Lennerz et al. Proc. Natl. Acad. Sci. U.S.A. 102(44): 16013-8 (2005). |
| 14 | HAUS3 | ILNAMIAKI (SEQ ID NO: 429) | Robbins et al. Nat Med. 19(6): 747-52 (2013). |
| 15 | LDLR-fucosyltransferase | WRRAPAPGA (SEQ ID NO: 430) and PVTWRRAPA (SEQ ID NO: 431) | Wang et al. J Exp Med. 189(10): 1659-68 (1999). |
| 16 | MART2 | FLEGNEVGKTY (SEQ ID NO: 432) | Kawakami et al. J Immunol. 166(4): 2871-7 (2001). |
| 17 | MATN | KTLTSVFQK (SEQ ID NO: 433) | Robbins et al. Nat Med. 19(6): 747-52 (2013). |
| 18 | MUM-1 | EEKLIVVLF (SEQ ID NO: 434) | Coulie et al. Proc. Natl. Acad. Sci. U.S.A. 92(17): 7976-80 (1995). |
| 19 | MUM-2 | SELFRSGLDSY (SEQ ID NO: 435) and FRSGLDSYV(SEQ ID NO: 436) | Chiari et al. Cancer Res. 59(22): 5785-92 (1999). |
| 20 | MUM-3 | EAFIQPITR (SEQ ID NO: 437) | Baurain et al. J. Immunol. 164(11): 6057-66 (2000). |
| 21 | neo-PAP | RVIKNSIRLTL (SEQ ID NO: 438) | Topalian et al. Cancer Res. 62(19): 5505-9 (2002). |

TABLE 13-continued

| Melanoma | | | |
|---|---|---|---|
| No. | Tumor-associated antigen | Reported immunogenic epitopes | Sources |
| 22 | Myosin class I | KINKNPKYK (SEQ ID NO: 439) | Zorn, et al. Eur. J. Immunol. 29(2): 592-601 (1999). |
| 23 | PPP1R3B | YTDFHCQYV (SEQ ID NO: 440) | Robbins et al. Nat Med. 19(6): 747-52 (2013).<br>Lu et al. J Immunol. 190(12): 6034-42 (2013). |
| 24 | PRDX5 | LLLDDLLVSI (SEQ ID NO: 441) | Sensi et al. Cancer Res. 65(2): 632-40 (2005). |
| 25 | PTPRK | PYYFAAELPPRNLPEP (SEQ ID NO: 442) | Novellino et al. J. Immunol. 170(12): 6363-70 (2003). |
| 26 | N-ras | ILDTAGREEY (SEQ ID NO: 443) | Linard et al. J. Immunol. 168(9): 4802-8 (2002). |
| 27 | RBAF600 | RPHVPESAF (SEQ ID NO: 444) | Lennerz et al. Proc. Natl. Acad. Sci. U.S.A. 102(44): 16013-8 (2005). |
| 28 | SIRT2 | KIFSEVTLK (SEQ ID NO: 445) | Lennerz et al. Proc. Natl. Acad. Sci. U.S.A. 102(44): 16013-8 (2005). |
| 29 | SNRPD1 | SHETVIIEL (SEQ ID NO: 446) | Lennerz et al. Proc. Natl. Acad. Sci. U.S.A. 102(44): 16013-8 (2005). |
| 30 | Triosephosphate isomerase | GELIGILNAAKVPAD (SEQ ID NO: 447) | Pieper et al. J Exp Med. 189(5): 757-66 (1999). |
| 31 | OA1 | LYSACFWWL (SEQ ID NO: 448) | Touloukian et al. J. Immunol. 170(3): 1579-85 (2003). |
| 32 | RAB38/NY-MEL-1 | VLHWDPETV (SEQ ID NO: 449) | Walton et al. J Immunol. 177(11): 8212-8 (2006). |
| 33 | TRP-1/gp75 | MSLQRQFLR (SEQ ID NO: 450);<br>ISPNSVFSQWRVVCDSLEDY (SEQ ID NO: 451);<br>SLPYWNFATG (SEQ ID NO: 452); and<br>SQWRVVCDSLEDYDT (SEQ ID NO: 453) | Touloukian et al. Cancer Res. 62(18): 5144-7 (2002).<br>Robbins et al. J. Immunol. (10): 6036-47 (2002).<br>Osen et al. PLoS One. 5(11): e14137 (2010). |
| 34 | TRP-2 | SVYDFFVWL (SEQ ID NO: 454);<br>TLDSQVMSL (SEQ ID NO: 455);<br>LLGPGRPYR (SEQ ID NO: 456);<br>ANDPIFVVL (SEQ ID NO: 457);<br>QCTEVRADTRPWSGP (SEQ ID NO: 458); and<br>ALPYWNFATG (SEQ ID NO: 459) | Parkhurst et al. Cancer Res. 58(21): 4895-901 (1998).<br>Noppen et al. Int. J. Cancer. 87(2): 241-6 (2000).<br>Wang et al. J. Exp. Med. 1184(6): 2207-16 (1996).<br>Wang et al. J. Immunol. 160(2): 890-7(1998).<br>Castelli et al. J. Immunol. 162(3): 1739-48 (1999).<br>Paschen et al. Clin. Cancer Res. (14): 5241-7 (2005).<br>Robbins et al. J. Immunol. 169(10): 6036-47 (2002). |
| 35 | tyrosinase | KCDICTDEY (SEQ ID NO: 460);<br>SSDYVIPIGTY (SEQ ID NO: 461);<br>MLLAVLYCL (SEQ ID NO: 462);<br>CLLWSFQTSA (SEQ ID NO: 463);<br>YMDGTMSQV (SEQ ID NO: 464);<br>AFLPWHRLF (SEQ ID NO: 229);<br>IYMDGTADFSF (SEQ ID NO: 465); | Kittlesen et al. J. Immunol. 160(5): 2099-106 (1998).<br>Kawakami et al. J. Immunol. (12): 6985-92 (1998).<br>Wölfel et al. Eur. J. Immunol. 24(3): 759-64 (1994).<br>Riley et al. J. Immunother. 24(3): 212-20 (2001).<br>Skipper et al. J. Exp. Med. 183(2): 527-34 (1996).<br>Kang et al. J. Immunol. 155(3): 1343-8 (1995).<br>Dalet et al. Proc. Natl. Acad. Sci. U.S.A. 108(29): E323-31 (2011) |

TABLE 13-continued

| Melanoma | | | |
|---|---|---|---|
| No. | Tumor-associated antigen | Reported immunogenic epitopes | Sources |
| | | QCSGNFMGF (SEQ ID NO: 466); TPRLPSSADVEF (SEQ ID NO: 467); LPSSADVEF (SEQ ID NO: 468); LHHAFVDSIF (SEQ ID NO: 469); SEIWRDIDF (SEQ ID NO: 470); QNILLSNAPLGPQFP (SEQ ID NO: 471); SYLQDSDPDSFQD (SEQ ID NO: 661); and FLLHHAFVDSIFEQWLQR HRP (SEQ ID NO: 472) | Lennerz et al. Proc. Natl. Acad. Sci. U.S.A. 102(44): 16013-8 (2005). Benlalam et al. J. Immunol. 171(11): 6283-9 (2003). Morel et al. Int. J. Cancer. 83(6): 755-9 (1999). Brichard et al. Eur. J. Immunol. 26(1): 224-30 (1996). Topalian et al. J. Exp. Med. (5): 1965-71 (1996). Kobayashi et al. Cancer Res. 58(2): 296-301 (1998). |
| 36 | Melan-A/MART-1 | YTTAEEAAGIGILTVILGV LLLIGCWYCRR (SEQ ID NO: 473) | Meng et al. J. Immunother. 23: 525-534(2011) |
| 37 | gp100/Pmel17 | ALNFPGSQK (SEQ ID NO: 474) ALNFPGSQK (SEQ ID NO: 474) VYFFLPDHL (SEQ ID NO: 475) RTKQLYPEW (SEQ ID NO: 476) HTMEVTVYHR (SEQ ID NO: 477) SSPGCQPPA (SEQ ID NO: 478) VPLDCVLYRY (SEQ ID NO: 479) LPHSSSHWL (SEQ ID NO: 480) SNDGPTLI (SEQ ID NO: 481) GRAMLGTHTMEVTVY (SEQ ID NO: 482) WNRQLYPEWTEAQRLD (SEQ ID NO: 483) TTEWVETTARELPIPEPE (SEQ ID NO: 484) TGRAMLGTHTMEVTVYH (SEQ ID NO: 485) GRAMLGTHTMEVTVY (SEQ ID NO: 482) | El Hage et al. Proc. Natl. Acad. Sci. U.S.A. 105(29): 10119-24 (2008). Kawashima et al. Hum Immunol. 59(1): 1-14 (1998). Robbins et al. J Immunol. 159(1): 303-8 (1997). Sensi et al. Tissue Antigens. 59(4): 273-9 (2002). Lennerz et al. Proc Natl Acad Sci USA. 102(44): 16013-8 (2005). Benlalam et al. J Immunol. 171(11): 6283-9 (2003). Vigneron et al. Tissue Antigens. 65(2): 156-62 (2005). Castelli et al. J Immunol. 162(3): 1739-48 (1999). Touloukian et al. J Immunol. 164(7): 3535-42 (2000). Parkhurst et al. J Immunother. 27(2): 79-91 (2004). Lapointe et al. J Immunol. 167(8): 4758-64 (2001). Kobayashi et al. Cancer Res. 61(12): 4773-8 (2001). |
| 38 | NY-ESO-1 | HLA-A2-restricted peptide p157-165 (SLLMWITQC SEQ ID NO: 230)), HLA-Cw3-restricted p92-100 (LAMP-FATPM (SEQ ID NO: 231)) and HLA-Cw6-restricted p80-88 (ARGPESRLL (SEQ ID NO: 232)) SLLMWITQC (SEQ ID NO: 230) MLMAQEALAFL (SEQ ID NO: 233) YLAMPFATPME (SEQ ID NO: 234) ASGPGGGAPR (SEQ ID NO: 235) LAAQERRVPR (SEQ ID NO: 236) TVSGNILTIR (SEQ ID NO: 237) APRGPHGGAASGL (SEQ ID NO: 238) | Jager et al. Proc. Natl. Acad. Scie. U.S.A. 103(39): 14453-8 (2006). Gnjatic et al. PNAS Sep. 26, 2000 vol. 97 no. 20 p. 10919 Jager et al. J Exp Med. 187(2): 265-70 (1998). Chen et al. J Immunol. 165(2): 948-55 (2000). Valmori et al. Cancer Res. 60(16): 4499-506 (2000). Aarnoudse et al. Int J Cancer. 82(3): 442-8 (1999). Eikawa et al. Int J Cancer. 132(2): 345-54 (2013). Wang et al. J Immunol. 161(7): 3598-606 (1998). Matsuzaki et al. Cancer Immunol Immunother. 57(8)1185-95 (2008). Ebert et al. Cancer Res. 69(3): 1046-54 (2009). Eikawa et al. Int J Cancer. 132(2): 345-54 (2013). |

TABLE 13-continued

| Melanoma | | | |
|---|---|---|---|
| No. | Tumor-associated antigen | Reported immunogenic epitopes | Sources |
| | | MPFATPMEAEL (SEQ ID NO: 239)<br>KEFTVSGNILTI (SEQ ID NO: 240)<br>MPFATPMEA (SEQ ID NO: 241)<br>FATPMEAEL (SEQ ID NO: 242)<br>FATPMEAELAR (SEQ ID NO: 243)<br>LAMPFATPM (SEQ ID NO: 231)<br>ARGPESRLL (SEQ ID NO: 232)<br>SLLMWITQCFLPVF (SEQ ID NO: 244)<br>LLEFYLAMPFATPMEAEL-ARRSLAQ (SEQ ID NO: 245)<br>EFYLAMPFATPM (SEQ ID NO: 246)<br>PGVLLKEFTVSGNILTIRL-TAADHR (SEQ ID NO: 247)<br>RLLEFYLAMPFA (SEQ ID NO: 248)<br>QGAMLAAQERRVPRAAE-VPR (SEQ ID NO: 249)<br>PFATPMEAELARR (SEQ ID NO: 250)<br>PGVLLKEFTVSGNILTIRLT (SEQ ID NO: 251)<br>VLLKEFTVSG (SEQ ID NO: 252)<br>AADHRQLQLSISSCLQQL (SEQ ID NO: 253)<br>LKEFTVSGNILTIRL (SEQ ID NO: 254)<br>PGVLLKEFTVSGNILTIRL-TAADHR (SEQ ID NO: 247)<br>LLEFYLAMPFATPMEAEL-ARRSLAQ (SEQ ID NO: 245)<br>KEFTVSGNILT (SEQ ID NO: 255)<br>LLEFYLAMPFATPM (SEQ ID NO: 256)<br>AGATGGRGPRGAGA (SEQ ID NO: 257) | Knights et al. Cancer Immunol Immunother. 58(3): 325-38 (2009).<br>Jäger et al. Cancer Immun. 2: 12 (2002).<br>Zeng et al. Proc Natl Acad Sci USA. 98(7): 3964-9 (2001).<br>Mandic et al. J Immunol. 174(3): 1751-9 (2005).<br>Chen et al. Proc Natl Acad Sci USA. 101(25): 9363-8 (2004).<br>Ayyoub et al. Clin Cancer Res. 16(18): 4607-15 (2010).<br>Slager et al. J Immunol. 172(8): 5095-102 (2004).<br>Mizote et al. Vaccine. 28(32): 5338-46 (2010).<br>Jager et al. J Exp Med. 191(4): 625-30 (2000).<br>Zarour et al. Cancer Res. 60(17): 4946-52 (2000).<br>Zeng et al. J Immunol. 165(2): 1153-9(2000).<br>Bioley et al. Clin Cancer Res. 15(13): 4467-74 (2009).<br>Zarour et al. Cancer Res. 62(1): 213-8 (2002).<br>Hasegawa et al. Clin Cancer Res. 12(6): 1921-7 (2006). |
| 39 | BAGE-1 | AARAVFLAL (SEQ ID NO: 333) | Boel et al. Immunity. 2(2): 167-75 (1995). |
| 40 | GAGE-1,2,8 | YRPRPRRY (SEQ ID NO: 397) | Van den Eynde et al. J Exp Med. 182(3): 689-98 (1995). |
| 41 | GAGE-3,4,5,6,7 (cutaneous melanoma) | YYWPRPRRY (SEQ ID NO: 412) | De Backer et al. Cancer Res. 59(13): 3157-65 (1999). |
| 42 | GnTVf | VLPDVFIRC(V) (SEQ ID NO: 486) | Guilloux et al. J Exp Med. 183(3): 1173-83 (1996). |
| 43 | HERV-K-MEL | MLAVISCAV (SEQ ID NO: 309) | Schiavetti et al. Cancer Res. 62(19): 5510-6 (2002). |
| 44 | KK-LC-1 | RQKRILVNL (SEQ ID NO: 310) | Fukuyama et al. Cancer Res. 66(9): 4922-8 (2006). |

TABLE 13-continued

| Melanoma | | | |
|---|---|---|---|
| No. | Tumor-associated antigen | Reported immunogenic epitopes | Sources |
| 45 | KM-HN-1 | NYNNFYRFL (SEQ ID NO: 311)<br>EYSKECLKEF (SEQ ID NO: 312)<br>EYLSLSDKI (SEQ ID NO: 313) | Fukuyama et al. Cancer Res. 66(9): 4922-8 (2006).<br>Monji et al. Clin Cancer Res. 10(18 Pt 1): 6047-57 (2004). |
| 46 | LAGE-1 | MLMAQEALAFL (SEQ ID NO: 233)<br>SLLMWITQC (SEQ ID NO: 230)<br>LAAQERRVPR (SEQ ID NO: 236)<br>ELVRRILSR (SEQ ID NO: 314)<br>APRGVRMAV (SEQ ID NO: 315)<br>SLLMWITQCFLPVF (SEQ ID NO: 244)<br>QGAMLAAQERRVPRAAE VP-R (SEQ ID NO: 249)<br>AADHRQLQLSISSCLQQL (SEQ ID NO: 253)<br>CLSRRPWKRSWSAGSCP G-MPHL (SEQ ID NO: 316)<br>ILSRDAAPLPRPG (SEQ ID NO: 317)<br>AGATGGRGPRGAGA (SEQ ID NO: 257) | Aarnoudse et al. Int J Cancer. 82(3): 442-8 (1999).<br>Rimoldi et al. J Immunol. 165(12): 7253-61 (2000).<br>Wang et al. J Immunol. 161(7): 3598-606 (1998).<br>Sun et al. Cancer Immunol Immunother. 55(6): 644-52 (2006).<br>Stager et al. Cancer Gene Ther. 11(3): 227-36 (2004).<br>Zeng et al. Proc Natl Acad Sci USA. 98(7): 3964-9 (2001).<br>Slager et al. J Immunol. 172(8): 5095-102 (2004).<br>Jager et al. J Exp Med. 191(4): 625-30 (2000).<br>Slager et al. J Immunol. 170(3): 1490-7 (2003).<br>Wang et al. Immunity. 20(1): 107-18 (2004).<br>Hasegawa et al. Clin Cancer Res. 12(6): 1921-7 (2006). |
| 47 | LY6K | RYCNLEGPPI (SEQ ID NO: 487)<br>KWTEPYCVIAAVKIFPRF FMV-AKQ (SEQ ID NO: 488)<br>KCCKIRYCNLEGPPINSSVF (SEQ ID NO: 489) | Suda et al. Cancer Sci. 98(11): 1803-8 (2007).<br>Tomita et al. Oncoimmunology. 3: e28100 (2014). |
| 48 | MAGE-A1 | EADPTGHSY (SEQ ID NO: 334)<br>KVLEYVIKV (SEQ ID NO: 335)<br>SLFRAVITK (SEQ ID NO: 336)<br>EVYDGREHSA (SEQ ID NO: 337)<br>RVRFFFPSL (SEQ ID NO: 338)<br>EADPTGHSY (SEQ ID NO: 334)<br>REPVTKAEML (SEQ ID NO: 339)<br>KEADPTGHSY (SEQ ID NO: 340)<br>DPARYEFLW (SEQ ID NO: 341)<br>ITKKVADLVGF (SEQ ID NO: 342)<br>SAFPTTINF (SEQ ID NO: 343)<br>SAYGEPRKL (SEQ ID NO: 344)<br>RVRFFFPSL (SEQ ID NO: 338)<br>TSCILESLFRAVITK (SEQ ID NO: 345)<br>PRALAETSYVKVLEY (SEQ ID NO: 346)<br>FLLIKYRAREPVTKAE (SEQ ID NO: 347)<br>EYVIKVSARVRF (SEQ ID NO: 348) | Traversari et al. J Exp Med. 176(5): 1453-7 (1992).<br>Ottaviani et al. Cancer Immunol Immunother. 54(12): 1214-20 (2005).<br>Pascolo et al. Cancer Res. 61(10): 4072-7 (2001).<br>Chaux et al. J Immunol. 163(5): 2928-36 (1999).<br>Luiten et al. Tissue Antigens. 55(2): 149-52 (2000).<br>Luiten et al. Tissue Antigens. 56(1): 77-81 (2000).<br>Tanzarella et al. Cancer Res. 59(11): 2668-74 (1999).<br>Stroobant et al. Eur J Immunol. 42(6): 1417-28 (2012).<br>Corbière et al. Tissue Antigens. 63(5): 453-7 (2004).<br>Goodyear et al. Cancer Immunol Immunother. 60(12): 1751-61 (2011).<br>van der Bruggen et al. Eur J Immunol. 24(9): 2134-40 (1994).<br>Wang et al. Cancer Immunol Immunother. 56(6): 807-18 (2007).<br>Chaux et al. J Exp Med. 189(5): 767-78 (1999).<br>Chaux et al. Eur J Immunol. 31(6): 1910-6 (2001). |

TABLE 13-continued

| Melanoma | | | |
|---|---|---|---|
| No. | Tumor-associated antigen | Reported immunogenic epitopes | Sources |
| 49 | MAGE-A6 | MVKISGGPR (SEQ ID NO: 398)<br>EVDPIGHVY (SEQ ID NO: 399)<br>REPVTKAEML (SEQ ID NO: 339)<br>EGDCAPEEK (SEQ ID NO: 351)<br>ISGGPRISY (SEQ ID NO: 400)<br>LLKYRAREPVTKAE (SEQ ID NO: 352) | Zorn et al. Eur J Immunol. 29(2): 602-7 (1999).<br>Benlalam et al. J Immunol. 171(11): 6283-9 (2003).<br>Tanzarella et al. Cancer Res. 59(11): 2668-74 (1999).<br>Breckpot et al. J Immunol. 172(4): 2232-7 (2004).<br>Vantomme et al. Cancer Immun. 3:17 (2003).<br>Chaux et al. J Exp Med. 189(5): 767-78 (1999). |
| 50 | MAGE-A10 | GLYDGMEHL (SEQ ID NO: 490)<br>DPARYEFLW (SEQ ID NO: 341) | Huang et al. J Immunol. 162(11): 6849-54 (1999).<br>Chaux et al. J Immunol. 163(5): 2928-36 (1999). |
| 51 | MAGE-A12 | FLWGPRALV (SEQ ID NO: 491)<br>VRIGHLYIL (SEQ ID NO: 492)<br>EGDCAPEEK (SEQ ID NO: 351)<br>REPFTKAEMLGSVIR (SEQ ID NO: 493)<br>AELVHFLLLKYRAR (SEQ ID NO: 494) | van der Bruggen et al. Eur J Immunol. 24(12): 3038-43 (1994).<br>Heidecker et al. J Immunol. 164(11): 6041-5 (2000).<br>Panelli et al. J Immunol. 164(8): 4382-92 (2000).<br>Breckpot et al. J Immunol. 172(4): 2232-7 (2004).<br>Wang et al. Cancer Immunol Immunother. 56(6): 807-18 (2007).<br>Chaux et al. J Exp Med. 189(5): 767-78 (1999). |
| 52 | MAGE-C2 | LLFGLALIEV (SEQ ID NO: 495)<br>ALKDVEERV (SEQ ID NO: 496)<br>SESIKKKVL (SEQ ID NO: 497)<br>ASSTLYLVF (SEQ ID NO: 498)<br>SSTLYLVFSPSSFST (SEQ ID NO: 499) | Ma et al. Int J Cancer. 109(5): 698-702 (2004).<br>Godelaine et al. Cancer Immunol Immunother. 56(6): 753-9 (2007).<br>Ma et al. Int J Cancer. 129(10): 2427-34 (2011).<br>Wen et al. Cancer Sci. 102(8): 1455-61 (2011). |
| 53 | NA88-A | QGQHFLQKV (SEQ ID NO: 500) | Moreau-Aubry et al. J Exp Med. 191(9): 1617-24 (2000). |
| 54 | Sp17 | ILDSSEEDK (SEQ ID NO: 299) | Chiriva-Internati et al. Int J Cancer. 107(5): 863-5 (2003). |
| 55 | SSX-2 | KASEKIFYV (SEQ ID NO: 353)<br>EKIQKAFDDIAKYFSK (SEQ ID NO: 354)<br>FGRLQGISPKI (SEQ ID NO: 355)<br>WEKMKASEKIFYVYMKRK (SEQ ID NO: 356)<br>KIFYVYMKRKYEAMT (SEQ ID NO: 357)<br>KIFYVYMKRKYEAM (SEQ ID NO: 358) | Ayyoub et al. J Immunol. 168(4): 1717-22 (2002).<br>Ayyoub et al. J Immunol. 172(11): 7206-11 (2004).<br>Neumann et al. Cancer Immunol Immunother. 60(9): 1333-46 (2011).<br>Ayyoub et al. Clin Immunol. 114(1): 70-8 (2005).<br>Neumann et al. Int J Cancer. 112(4): 661-8 (2004).<br>Ayyoub et al. J Clin Invest. 113(8): 1225-33 (2004). |
| 56 | SSX-4 | INKTSGPKRGKHAWTHRLRE (SEQ ID NO: 322)<br>YFSKKEWEKMKSSEKIVYVY (SEQ ID NO: 323)<br>MKLNYEVMTKLGFKVTLPPF (SEQ ID NO: 324)<br>KHAWTHRLRERKQLVVYEEI (SEQ ID NO: 325)<br>LGFKVTLPPFMRSKRAADFH (SEQ ID NO: 326) | Ayyoub et al. J Immunol. 174(8): 5092-9 (2005).<br>Valmori et al. Clin Cancer Res. 12(2): 398-404 (2006). |

TABLE 13-continued

| Melanoma | | | |
|---|---|---|---|
| No. | Tumor-associated antigen | Reported immunogenic epitopes | Sources |
| | | KSSEKIVYVYMKLNYEV MTK (SEQ ID NO: 327) KHAWTHRLRERKQLVV YEEI (SEQ ID NO: 325) | |
| 57 | TRAG-3 | CEFHACWPAFTVLGE (SEQ ID NO: 359) | Janjic et al. J Immunol. 177(4): 2717-27 (2006). |
| 58 | TRP2-INT2g | EVISCKLIKR (SEQ ID NO: 501) | Lupetti et al. J Exp Med. 188(6): 1005-16 (1998). |
| 59 | pgk | | Morgan et al., J. Immunol. 171: 3287-3295 (2003) |

TABLE 14

| Squamous cell carcinoma | | | |
|---|---|---|---|
| No. | Tumor-associated antigen | Reported immunogenic epitopes | Sources |
| 1 | CASP-8 | FPSDSWCYF (SEQ ID NO: 502) | Mandruzzato et al. J. Exp. Med. 186(5): 785-93 (1997). |
| 2 | p53 | VVPCEPPEV (SEQ ID NO: 276) | Ito et al. Int. J. Cancer. 120(12): 2618-24 (2007). |
| 3 | SAGE | LYATVIHDI (SEQ ID NO: 503) | Miyahara et al. Clin Cancer Res. 11(15): 5581-9 (2005). |

TABLE 15

| Chronic myeloid leukemia | | | |
|---|---|---|---|
| No. | Tumor-associated antigen | Reported immunogenic epitopes | Sources |
| 1 | BCR-ABL | SSKALQRPV (SEQ ID NO: 504); GFKQSSKAL (SEQ ID NO: 505); ATGFKQSSKALQRPVAS (SEQ ID NO: 506); and ATGFKQSSKALQRPVAS (SEQ ID NO: 506) | Yotnda et al. J. Clin. Invest. 101(10): 2290-6 (1998). Bosch et al. Blood. 88(9): 3522-7 (1996). Makita et al. Leukemia. 16(12): 2400-7 (2002). |
| 2 | dek-can | TMKQICKKEIRRLHQY (SEQ ID NO: 507) | Makita et al. Leukemia. 16(12): 2400-7 (2002). |
| 3 | EFTUD2 | KILDAVVAQK (SEQ ID NO: 508) | Lennerz et al. Proc. Natl. Acad. Sci. U.S.A. 102(44): 16013-8 (2005). |
| 4 | GAGE-3,4,5,6,7 | YYWPRPRRY (SEQ ID NO: 412) | De Backer et al. Cancer Res. 59(13): 3157-65 (1999). |

TABLE 16

| Acute lymphoblastic leukemia | | | |
|---|---|---|---|
| No. | Tumor-associated antigen | Reported immunogenic epitopes | Sources |
| 1 | ETV6-AML1 | RIAECILGM (SEQ ID NO: 509) and IGRIAECILGMNPSR (SEQ ID NO: 510) | Yotnda et al. J. Clin. Invest. (2): 455-62 (1998). Yun et al. Tissue Antigens. 54(2): 153-61 (1999). |
| 2 | GAGE-3,4,5,6,7 | YYWPRPRRY(SEQ ID NO: 412) | De Backer et al. Cancer Res. 59(13): 3157-65 (1999). |

TABLE 17

| Acute myelogenous leukemia | | | |
|---|---|---|---|
| No. | Tumor-associated antigen | Reported immunogenic epitopes | Sources |
| 1 | FLT3-ITD | YVDFREYEYY (SEQ ID NO: 511) | Graf et al. Blood. 109(7): 2985-8 (2007). |
| 2 | Cyclin-A1 | FLDRFLSCM (SEQ ID NO: 512) and SLIAAAAFCLA (SEQ ID NO: 513) | Ochsenreither et al. Blood. 119(23): 5492-501 (2012). |
| 3 | GAGE-3,4,5,6,7 | YYWPRPRRY (SEQ ID NO: 412) | De Backer et al. Cancer Res. 59(13): 3157-65 (1999). |

TABLE 18

| Chronic lymphocytic leukemia | | | |
|---|---|---|---|
| No. | Tumor-associated antigen | Reported immunogenic epitopes | Sources |
| 1 | FNDC3B | VVMSWAPPV (SEQ ID NO: 514) | Rajasagi et al. Blood. 124(3): 453-62 (2014). |
| 2 | GAGE-3,4,5,6,7 | YYWPRPRRY (SEQ ID NO: 412) | De Backer et al. Cancer Res. 59(13): 3157-65 (1999). |

TABLE 19

| Promyelocytic leukemia | | | |
|---|---|---|---|
| No. | Tumor-associated antigen | Reported immunogenic epitopes | Sources |
| 1 | pml-RARalpha | NSNHVASGAGEAAIETQS SSSEEIV (SEQ ID NO: 515) | Gambacorti-Passerini et al. Blood. 81(5): 1369-75 (1993). |
| 2 | GAGE-3,4,5,6,7 | YYWPRPRRY (SEQ ID NO: 412) | De Backer et al. Cancer Res. 59(13): 3157-65 (1999). |

TABLE 20

| Multiple myeloma | | | |
|---|---|---|---|
| No. | Tumor-associated antigen | Reported immunogenic epitopes | Sources |
| 1 | MAGE-C1 | ILFGISLREV (SEQ ID NO: 516)<br>KVVEFLAML (SEQ ID NO: 517)<br>SSALLSIFQSSPE (SEQ ID NO: 518)<br>SFSYTLLSL (SEQ ID NO: 519)<br>VSSFFSYTL (SEQ ID NO: 520) | Anderson et al. Cancer Immunol Immunother. 60(7): 985-97 (2011).<br>Nuber et al. Proc Natl Acad Sci USA. 107(34): 15187-92 (2010). |
| 2 | NY-ESO-1 | HLA-A2-restricted peptide p157-165 (SLLMWITQC (SEQ ID NO: 230)), HLA-Cw3-restricted p92-100 LAMP-FATPM (SEQ ID NO: 231)) and HLA-Cw6-restricted p80-88 (ARGPESRLL (SEQ ID NO: 232))<br>SLLMWITQC (SEQ ID NO: 230)<br>MLMAQEALAFL (SEQ ID NO: 233)<br>YLAMPFATPME (SEQ ID NO: 234)<br>ASGPGGGAPR (SEQ ID NO: 235)<br>LAAQERRVPR (SEQ ID NO: 236)<br>TVSGNILTIR (SEQ ID NO: 237)<br>APRGPHGGAASGL (SEQ ID NO: 238)<br>MPFATPMEAEL (SEQ ID NO: 239)<br>KEFTVSGNILTI (SEQ ID NO: 240)<br>MPFATPMEA (SEQ ID NO: 241)<br>FATPMEAEL (SEQ ID NO: 242)<br>FATPMEAELAR (SEQ ID NO: 243)<br>LAMPFATPM (SEQ ID NO: 231)<br>ARGPESRLL (SEQ ID NO: 232)<br>SLLMWITQCFLPVF (SEQ ID NO: 244)<br>LLEFYLAMPFATPMEAEL-ARRSLAQ (SEQ ID NO: 245)<br>EFYLAMPFATPM (SEQ ID NO: 246)<br>PGVLLKEFTVSGNILTIRL-TAADHR (SEQ ID NO: 247)<br>RLLEFYLAMPFA (SEQ ID NO: 248)<br>QGAMLAAQERRVPRAAE-VPR (SEQ ID NO: 249)<br>PFATPMEAELARR SEQ ID NO: 250)<br>PGVLLKEFTVSGNILTIRLT (SEQ ID NO: 251)<br>VLLKEFTVSG (SEQ ID NO: 252)<br>AADHRQLQLSISSCLQQL (SEQ ID NO: 253)<br>LKEFTVSGNILTIRL (SEQ ID NO: 254) | Jager et al. Proc. Natl. Acad. Scie. U.S.A. 103(39): 14453-8 (2006).<br>Gnjatic et al. PNAS Sep. 26, 2000 vol. 97 no. 20 p. 10919<br>Jager et al. J Exp Med. 187(2): 265-70 (1998).<br>Chen et al. J Immunol. 165(2): 948-55 (2000).<br>Valmori et al. Cancer Res. 60(16): 4499-506 (2000).<br>Aarnoudse et al. Int J Cancer. 82(3): 442-8 (1999).<br>Eikawa et al. Int J Cancer. 132(2): 345-54 (2013).<br>Wang et al. J Immunol. 161(7): 3598-606 (1998).<br>Matsuzaki et al. Cancer Immunol Immunother. 57(8)1185-95 (2008).<br>Ebert et al. Cancer Res. 69(3): 1046-54 (2009).<br>Eikawa et al. Int J Cancer. 132(2): 345-54 (2013).<br>Knights et al. Cancer Immunol Immunother. 58(3): 325-38 (2009).<br>Jäger et al. Cancer Immun. 2: 12 (2002).<br>Zeng et al. Proc Natl Acad Sci USA. 98(7): 3964-9 (2001).<br>Mandic et al. J Immunol. 174(3): 1751-9 (2005).<br>Chen et al. Proc Natl Acad Sci USA. 101(25): 9363-8 (2004).<br>Ayyoub et al. Clin Cancer Res. 16(18): 4607-15 (2010).<br>Slager et al. J Immunol. 172(8): 5095-102 (2004).<br>Mizote et al. Vaccine. 28(32): 5338-46 (2010).<br>Jager et al. J Exp Med. 191(4): 625-30 (2000).<br>Zarour et al. Cancer Res. 60(17): 4946-52 (2000).<br>Zeng et al. J Immunol. 165(2): 1153-9(2000).<br>Bioley et al. Clin Cancer Res. 15(13): 4467-74 (2009).<br>Zarour et al. Cancer Res. 62(1): 213-8 (2002).<br>Hasegawa et al. Clin Cancer Res. 12(6): 1921-7 (2006). |

TABLE 20-continued

| Multiple myeloma | | | |
|---|---|---|---|
| No. | Tumor-associated antigen | Reported immunogenic epitopes | Sources |
| | | PGVLLKEFTVSGNILTIRL-TAADHR (SEQ ID NO: 247)<br>LLEFYLAMPFATPMEAEL-ARRSLAQ (SEQ ID NO: 245)<br>KEFTVSGNILT (SEQ ID NO: 255)<br>LLEFYLAMPFATPM (SEQ ID NO: 256)<br>AGATGGRGPRGAGA (SEQ ID NO: 257) | |
| 3 | LAGE-1 | MLMAQEALAFL (SEQ ID NO: 233)<br>SLMMWITQC (SEQ ID NO: 230)<br>LAAQERRVPR (SEQ ID NO: 236)<br>ELVRRILSR (SEQ ID NO: 314)<br>APRGVRMAV (SEQ ID NO: 315)<br>SLLMWITQCFLPVF (SEQ ID NO: 244)<br>QGAMLAAQERRVPRAAE VP-R (SEQ ID NO: 249)<br>AADHRQLQLSISSCLQQL (SEQ ID NO: 253)<br>CLSRRPWKRSWSAGSCP G-MPHL (SEQ ID NO: 316)<br>ILSRDAAPLPRPG (SEQ ID NO: 317)<br>AGATGGRGPRGAGA (SEQ ID NO: 257) | Aarnoudse et al. Int J Cancer. 82(3): 442-8 (1999).<br>Rimoldi et al. J Immunol. 165(12): 7253-61 (2000).<br>Wang et al. J Immunol. 161(7): 3598-606 (1998).<br>Sun et al. Cancer Immunol Immunother. 55(6): 644-52 (2006).<br>Slager et al. Cancer Gene Ther. 11(3): 227-36 (2004).<br>Zeng et al. Proc Natl Acad Sci USA. 98(7): 3964-9 (2001).<br>Slager et al. J Immunol. 172(8): 5095-102 (2004).<br>Jager et al. J Exp Med. 191(4): 625-30 (2000).<br>Slager et al. J Immunol. 170(3): 1490-7 (2003).<br>Wang et al. Immunity. 20(1): 107-18 (2004).<br>Hasegawa et al. Clin Cancer Res. 12(6): 1921-7 (2006). |
| 4 | HERV-K-MEL | MLAVISCAV (SEQ ID NO: 309) | Schiavetti et al. Cancer Res. 62(19): 5510-6 (2002). |
| 5 | KK-LC-1 | RQKRILVNL (SEQ ID NO: 310) | Fukuyama et al. Cancer Res. 66(9): 4922-8 (2006). |
| 6 | KM-HN-1 | NYNNFYRFL (SEQ ID NO: 311)<br>EYSKECLKEF (SEQ ID NO: 312)<br>EYLSLSDKI (SEQ ID NO: 313) | Fukuyama et al. Cancer Res. 66(9): 4922-8 (2006).<br>Monji et al. Clin Cancer Res. 10(18 Pt 1): 6047-57 (2004). |
| 7 | Sp17 | ILDSSEEDK (SEQ ID NO: 299) | Chiriva-Internati et al. Int J Cancer. 107(5): 863-5 (2003). |

TABLE 21

| B-cell lymphoma | | | |
|---|---|---|---|
| No. | Tumor-associated antigen | Reported immunogenic epitopes | Sources |
| 1 | D393-CD20 | KPLFRRMSSLELVIA (SEQ ID NO: 521) | Vauchy et al. Int J Cancer. 137(1): 116-26 (2015). |

TABLE 22

| Bladder carcinoma | | | |
|---|---|---|---|
| No. | Tumor-associated antigen | Reported immunogenic epitopes | Sources |
| 1 | BAGE-1 | AARAVFLAL (SEQ ID NO: 333) | Boel et al. Immunity. 2(2): 167-75 (1995). |
| 2 | GAGE-1,2,8 | YRPRPRRY (SEQ ID NO: 397) | Van den Eynde et al. J Exp Med. 182(3): 689-98 (1995). |
| 3 | GAGE-3,4,5,6,7 | YYWPRPRRY (SEQ ID NO: 412) | De Backer et al. Cancer Res. 59(13): 3157-65 (1999). |
| 4 | MAGE-A4 (transitional cell carcinoma of urinary bladder) | EVDPASNTY (SEQ ID NO: 318)<br>GVYDGREHTV (SEQ ID NO: 319)<br>NYKRCFPVI (SEQ ID NO: 320)<br>SESLKMIF (SEQ ID NO: 321) | Kobayashi et al. Tissue Antigens. 62(5): 426-32 (2003).<br>Duffour et al. Eur J Immunol. 29(10): 3329-37 (1999).<br>Miyahara et al. Clin Cancer Res. 11(15): 5581-9 (2005).<br>Ottaviani et al. Cancer Immunol Immunother. 55(7): 867-72 (2006).<br>Zhang et al. Tissue Antigens. 60(5): 365-71 (2002). |
| 5 | MAGE-A6 | MVKISGGPR (SEQ ID NO: 398)<br>EVDPIGHVY (SEQ ID NO: 399)<br>REPVTKAEML (SEQ ID NO: 339)<br>EGDCAPEEK (SEQ ID NO: 351)<br>ISGGPRISY (SEQ ID NO: 400)<br>LLKYRAREPVTKAE (SEQ ID NO: 352) | Zorn et al. Eur J Immunol. 29(2): 602-7 (1999).<br>Benlalam et al. J Immunol. 171(11): 6283-9 (2003).<br>Tanzarella et al. Cancer Res. 59(11): 2668-74 (1999).<br>Breckpot et al. J Immunol. 172(4): 2232-7 (2004).<br>Vantomme et al. Cancer Immun. 3: 17 (2003).<br>Chaux et al. J Exp Med. 189(5): 767-78 (1999). |
| 6 | SAGE | LYATVIHDI (SEQ ID NO: 503) | Miyahara et al. Clin Cancer Res. 11(15): 5581-9 (2005). |
| 7 | NY-ESO-1 | HLA-A2-restricted peptide p157-165 (SLLMWITQC (SEQ ID NO: 230)), HLA-Cw3-restricted p92-100 (LAMP-FATPM (SEQ ID NO: 231)) and HLA-Cw6-restricted p80-88 (ARGPESRLL (SEQ ID NO: 232))<br>SLLMWITQC (SEQ ID NO: 230)<br>MLMAQEALAFL (SEQ ID NO: 233)<br>YLAMPFATPME (SEQ ID NO: 234)<br>ASGPGGGAPR (SEQ ID NO: 235)<br>LAAQERRVPR (SEQ ID NO: 236)<br>TVSGNILTIR (SEQ ID NO: 237)<br>APRGPHGGAASGL (SEQ ID NO: 238)<br>MPFATPMEAEL (SEQ ID NO: 239)<br>KEFTVSGNILTI (SEQ ID NO: 240)<br>MPFATPMEA (SEQ ID NO: 241)<br>FATPMEAEL (SEQ ID NO: 242)<br>FATPMEAELAR (SEQ ID NO: 243)<br>LAMPFATPM (SEQ ID NO: 231)<br>ARGPESRLL (SEQ ID NO: 232) | Jager et al. Proc. Natl. Acad. Scie. U.S.A. 103(39): 14453-8 (2006).<br>Gnjatic et al. PNAS Sep. 26, 2000 vol. 97 no. 20 p. 10919<br>Jager et al. J Exp Med. 187(2): 265-70 (1998).<br>Chen et al. J Immunol. 165(2): 948-55 (2000).<br>Valmori et al. Cancer Res. 60(16): 4499-506 (2000).<br>Aarnoudse et al. Int J Cancer. 82(3): 442-8 (1999).<br>Eikawa et al. Int J Cancer. 132(2): 345-54 (2013).<br>Wang et al. J Immunol. 161(7): 3598-606 (1998).<br>Matusuzki et al. Cancer Immunol Immunother. 57(8)1185-95 (2008).<br>Ebert et al. Cancer Res. 69(3): 1046-54 (2009).<br>Eikawa et al. Int J Cancer. 132(2): 345-54 (2013).<br>Knights et al. Cancer Immunol Immunother. 58(3): 325-38 (2009).<br>Jäger et al. Cancer Immun. 2: 12 (2002).<br>Zeng et al. Proc Natl Acad Sci USA. 98(7): 3964-9 (2001).<br>Mandic et al. J Immunol. 174(3): 1751-9 (2005).<br>Chen et al. Proc Natl Acad Sci USA. 101(25): 9363-8 (2004).<br>Ayyoub et al. Clin Cancer Res. 16(18): 4607-15 (2010).<br>Slager et al. J Immunol. 172(8): 5095-102 (2004). |

TABLE 22-continued

Bladder carcinoma

| No. | Tumor-associated antigen | Reported immunogenic epitopes | Sources |
|---|---|---|---|
| | | SLLMWITQCFLPVF (SEQ ID NO: 244)<br>LLEFYLAMPFATPMEAEL-ARRSLAQ (SEQ ID NO: 245)<br>EFYLAMPFATPM (SEQ ID NO: 246)<br>PGVLLKEFTVSGNILTIRL-TAADHR (SEQ ID NO: 247)<br>RLLEFYLAMPFA (SEQ ID NO: 248)<br>QGAMLAAQERRVPRAAE-VPR (SEQ ID NO: 249)<br>PFATPMEAELARR (SEQ ID NO: 250)<br>PGVLLKEFTVSGNILTIRLT (SEQ ID NO: 251)<br>VLLKEFTVSG (SEQ ID NO: 252)<br>AADHRQLQLSISSCLQQL (SEQ ID NO: 253)<br>LKEFTVSGNILTIRL (SEQ ID NO: 254)<br>PGVLLKEFTVSGNILTIRL-TAADHR (SEQ ID NO: 247)<br>LLEFYLAMPFATPMEAEL-ARRSLAQ (SEQ ID NO: 245)<br>KEFTVSGNILT (SEQ ID NO: 255)<br>LLEFYLAMPFATPM (SEQ ID NO: 256)<br>AGATGGRGPRGAGA (SEQ ID NO: 257) | Mizote et al. Vaccine. 28(32): 5338-46 (2010).<br>Jager et al. J Exp Med. 191(4): 625-30 (2000).<br>Zarour et al. Cancer Res. 60(17): 4946-52 (2000).<br>Zeng et al. J Immunol. 165(2): 1153-9 (2000).<br>Bioley et al. Clin Cancer Res. 15(13): 4467-74 (2009).<br>Zarour et al. Cancer Res. 62(1): 213-8 (2002).<br>Hasegawa et al. Clin Cancer Res. 12(6): 1921-7 (2006). |
| 8 | LAGE-1 | MLMAQEALAFL (SEQ ID NO: 233)<br>SLLMWITQC (SEQ ID NO: 230)<br>LAAQERRVPR (SEQ ID NO: 236)<br>ELVRRILSR (SEQ ID NO: 314)<br>APRGVRMAV (SEQ ID NO: 315)<br>SLLMWITQCFLPVF (SEQ ID NO: 244)<br>QGAMLAAQERRVPRAAE VP-R (SEQ ID NO: 249)<br>AADHRQLQLSISSCLQQL (SEQ ID NO: 253)<br>CLSRRPWKRSWSAGSCP G-MPHL (SEQ ID NO: 316)<br>ILSRDAAPLPRPG (SEQ ID NO: 317)<br>AGATGGRGPRGAGA (SEQ ID NO: 257) | Aarnoudse et al. Int J Cancer. 82(3): 442-8 (1999).<br>Rimoldi et al. J Immunol. 165(12): 7253-61 (2000).<br>Wang et al. J Immunol. 161(7): 3598-606 (1998).<br>Sun et al. Cancer Immunol Immunother. 55(6): 644-52 (2006).<br>Slager et al. Cancer Gene Ther. 11(3): 227-36 (2004).<br>Zeng et al. Proc Natl Acad Sci USA. 98(7): 3964-9 (2001).<br>Slager et al. J Immunol. 172(8): 5095-102 (2004).<br>Jager et al. J Exp Med. 191(4): 625-30 (2000).<br>Slager et al. J Immunol. 170(3): 1490-7 (2003).<br>Wang et al. Immunity. 20(1): 107-18 (2004).<br>Hasegawa et al. Clin Cancer Res. 12(6): 1921-7 (2006). |
| 9 | HERV-K-MEL | MLAVISCAV (SEQ ID NO: 309) | Schiavetti et al. Cancer Res. 62(19): 5510-6 (2002). |
| 10 | KK-LC-1 | RQKRILVNL (SEQ ID NO: 310) | Fukuyama et al. Cancer Res. 66(9): 4922-8 (2006). |
| 11 | KM-HN-1 | NYNNFYRFL (SEQ ID NO: 311)<br>EYSKECLKEF (SEQ ID NO: 312)<br>EYLSLSDKI (SEQ ID NO: 313) | Fukuyama et al. Cancer Res. 66(9): 4922-8 (2006).<br>Monji et al. Clin Cancer Res. 10(18 Pt 1): 6047-57 (2004). |

TABLE 22-continued

| Bladder carcinoma | | | |
|---|---|---|---|
| No. | Tumor-associated antigen | Reported immunogenic epitopes | Sources |
| 12 | SP17 | ILDSSEEDK (SEQ ID NO: 299) | Chiriva-Internati et al. Int J Cancer. 107(5): 863-5 (2003). |

TABLE 23

| Head and neck cancer | | | |
|---|---|---|---|
| No. | Tumor-associated antigen | Reported immunogenic epitopes | Sources |
| 1 | BAGE-1 (head and neck squamous cell carcinoma) | AARAVFLAL (SEQ ID NO: 333) | Boel et al. Immunity. 2(2): 167-75 (1995). |
| 2 | GAGE-1,2,8 | YRPRPRRY (SEQ ID NO: 397) | Van den Eynde et al. J Exp Med. 182(3): 689-98 (1995). |
| 3 | GAGE-3,4,5,6,7 | YYWPRPRRY (SEQ ID NO: 412) | De Backer et al. Cancer Res. 59(13): 3157-65 (1999). |
| 4 | LY6K | RYCNLEGPPI (SEQ ID NO: 487)<br>KWTEPYCVIAAVKIFPRFFMV-AKQ (SEQ ID NO: 488)<br>KCCKIRYCNLEGPPINSSVF (SEQ ID NO: 489) | Suda et al. Cancer Sci. 98(11): 1803-8 (2007).<br>Tomita et al. Oncoimmunology. 3: e28100 (2014). |
| 5 | MAGE-A3 (head and neck squamous cell carcinoma) | EVDPIGHLY (SEQ ID NO: 662)<br>FLWGPRALV (SEQ ID NO: 491)<br>KVAELVHFL (SEQ ID NO: 663)<br>TFPDLESEF (SEQ ID NO: 664)<br>VAELVHFLL (SEQ ID NO: 665)<br>MEVDPIGHLY (SEQ ID NO: 666)<br>EVDPIGHLY (SEQ ID NO: 662)<br>REPVTKAEML (SEQ ID NO: 339)<br>AELVHFLLL (SEQ ID NO: 667)<br>MEVDPIGHLY (SEQ ID NO: 666)<br>WQYFFPVIF (SEQ ID NO: 668)<br>EGDCAPEEK (SEQ ID NO: 351)<br>KKLLTQHFVQENYLEY (SEQ ID NO: 669)<br>RKVAELVHFLLLKYR (SEQ ID NO: 670)<br>KKLLTQHFVQENYLEY (SEQ ID NO: 669)<br>ACYEFLWGPRALVETS (SEQ ID NO: 671)<br>RKVAELVHFLLLKYR (SEQ ID NO: 670)<br>VIFSKASSSLQL (SEQ ID NO: 672)<br>VFGIELMEVDPIGHL (SEQ ID NO: 673)<br>GDNQIMPKAGLLIIV (SEQ ID NO: 674) | Gaugler et al. J Exp Med. 179(3): 921-30 (1994).<br>van der Bruggen et al. Eur J Immunol. 24(12): 3038-43 (1994).<br>Kawashima et al. Hum Immunol. 59(1): 1-14 (1998).<br>Oiso et al. Int J Cancer. 81(3): 387-94 (1999).<br>Miyagawa et al. Oncology. 70(1): 54-62 (2006).<br>Bilsborough et al. Tissue Antigens. 60(1): 16-24 (2002).<br>Schultz et al. Tissue Antigens. 57(2): 103-9 (2001).<br>Tanzarella et al. Cancer Res. 59(11): 2668-74 (1999).<br>Schultz et al. J Exp Med. 195(4): 391-9 (2002).<br>Herman et al. Immunogenetics. 43(6): 377-83 (1996).<br>Russo et al. Proc Natl Acad Sci USA. 97(5): 2185-90 (2000).<br>Breckpot et al. J Immunol. 172(4): 2232-7 (2004).<br>Schultz et al. Cancer Res. 60(22): 6272-5 (2000).<br>Cesson et al. Cancer Immunol Immunother. 60(1): 23-35 (2011).<br>Schultz et al. J Immunol. 172(2): 1304-10 (2004).<br>Zhang et al. J Immunol. 171(1): 219-25 (2003).<br>Cesson et al. Cancer Immunol Immunother. 60(1): 23-35 (2010).<br>Kobayashi et al. Cancer Res. 61(12): 4773-8 (2001).<br>Cesson et al. Cancer Immunol Immunother. 60(1): 23-35 (2011).<br>Consogno et al. Blood. 101(3): 1038-44 (2003). |

TABLE 23-continued

| Head and neck cancer | | | |
|---|---|---|---|
| No. | Tumor-associated antigen | Reported immunogenic epitopes | Sources |
| | | TSYVKVLHHMVKISG (SEQ ID NO: 675)<br>RKVAELVHFLLLKYRA (SEQ ID NO: 676)<br>FLLLKYRAREPVTKAE (SEQ ID NO: 347) | Manici et al. J Exp Med. 189(5): 871-6 (1999).<br>Chaux et al. J Exp Med. 189(5): 767-78 (1999). |
| 6 | MAGE-A6 | MVKISGGPR (SEQ ID NO: 398)<br>EVDPIGHVY (SEQ ID NO: 399)<br>REPVTKAEML (SEQ ID NO: 339)<br>EGDCAPEEK (SEQ ID NO: 351)<br>ISGGPRISY (SEQ ID NO: 400)<br>LLKYRAREPVTKAE (SEQ ID NO: 352) | Zorn et al. Eur J Immunol. 29(2): 602-7 (1999).<br>Benlalam et al. J Immunol. 171(11): 6283-9 (2003).<br>Tanzarella et al. Cancer Res. 59(11): 2668-74 (1999).<br>Breckpot et al. J Immunol. 172(4): 2232-7 (2004).<br>Vantomme et al. Cancer Immun. 3: 17 (2003).<br>Chaux et al. J Exp Med. 189(5): 767-78 (1999). |
| 7 | SAGE | LYATVIHDI (SEQ ID NO: 503) | Miyahara et al. Clin Cancer Res. 11(15): 5581-9 (2005). |

TABLE 24

| Esophageal cancer | | | |
|---|---|---|---|
| No. | Tumor-associated antigen | Reported immunogenic epitopes | Sources |
| 1 | GAGE-3,4,5,6,7 (Esophageal squamous cell carcinoma and esophageal adenocarcinoma) | YYWPRPRRY (SEQ ID NO: 412) | De Backer et al. Cancer Res. 59(13): 3157-65 (1999). |
| 2 | MAGE-A2 | YLQLVFGIEV (SEQ ID NO: 349)<br>EYLQLVFGI (SEQ ID NO: 350)<br>REPVTKAEML (SEQ ID NO: 339)<br>EGDCAPEEK (SEQ ID NO: 351)<br>LLKYRAREPVTKAE (SEQ ID NO: 352) | Kawashima et al. Hum Immunol. 59(1): 1-14 (1998).<br>Tahara et al. Clin Cancer Res. 5(8): 2236-41 (1999).<br>Tanzarella et al. Cancer Res. 59(11): 2668-74 (1999).<br>Breckpot et al. J Immunol. 172(4): 2232-7 (2004).<br>Chaux et al. J Exp Med. 189(5): 767-78 (1999). |
| 3 | MAGE-A6 | MVKISGGPR (SEQ ID NO: 398)<br>EVDPIGHVY (SEQ ID NO: 399)<br>REPVTKAEML (SEQ ID NO: 339)<br>EGDCAPEEK (SEQ ID NO: 351)<br>ISGGPRISY (SEQ ID NO: 400)<br>LLKYRAREPVTKAE (SEQ ID NO: 352) | Zorn et al. Eur J Immunol. 29(2): 602-7 (1999).<br>Benlalam et al. J Immunol. 171(11): 6283-9 (2003).<br>Tanzarella et al. Cancer Res. 59(11): 2668-74 (1999).<br>Breckpot et al. J Immunol. 172(4): 2232-7 (2004).<br>Vantomme et al. Cancer Immun. 3: 17 (2003).<br>Chaux et al. J Exp Med. 189(5): 767-78 (1999). |
| 4 | NY-ESO-1 | HLA-A2-restricted peptide p157-165 (SLLMWITQC (SEQ ID NO: 230)), HLA-Cw3-restricted p92-100 (LAMP-FATPM (SEQ ID NO: 231)) and HLA-Cw6-restricted p80-88 (ARGPESRLL (SEQ ID NO: 232)) | Jager et al. Proc. Natl. Acad. Scie. U.S.A. 103(39): 14453-8 (2006).<br>Gnjatic et al. PNAS Sep. 26, 2000 vol. 97 no. 20 p. 10919<br>Jager et al. J Exp Med. 187(2): 265-70 (1998).<br>Chen et al. J Immunol. 165(2): 948-55 (2000). |

TABLE 24-continued

| Esophageal cancer | | | |
|---|---|---|---|
| No. | Tumor-associated antigen | Reported immunogenic epitopes | Sources |
| | | SLLMWITQC (SEQ ID NO: 230) | Valmori et al. Cancer Res. 60(16): 4499-506 (2000). |
| | | MLMAQEALAFL (SEQ ID NO: 233) | Aarnoudse et al. Int. J Cancer. 82(3): 442-8 (1999). |
| | | YLAMPFATPME (SEQ ID NO: 234) | Eikawa et al. Int J Cancer. 132(2): 345-54 (2013). |
| | | ASGPGGGAPR (SEQ ID NO: 235) | Wang et al. J Immunol 161(7): 3598-606 (1998). |
| | | LAAQERRVPR (SEQ ID NO: 236) | Matsuzaki et al. Cancer Immunol Immunother. 57(8)1185-95 (2008). |
| | | TVSGNILTIR (SEQ ID NO: 237) | Ebert et al. Cancer Res. 69(3): 1046-54 (2009). |
| | | APRGPHGGAASGL (SEQ ID NO: 238) | Eikawa et al. Int J Cancer. 132(2): 345-54 (2013). |
| | | MPFATPMEAEL (SEQ ID NO: 239) | Knights et al. Cancer Immunol Immunother. 58(3): 325-38 (2009). |
| | | KEFTVSGNILTI (SEQ ID NO: 240) | Jäger et al. Cancer Immun. 2: 12 (2002). |
| | | MPFATPMEA (SEQ ID NO: 241) | Zeng et al. Proc Natl Acad Sci USA. 98(7): 3964-9 (2001). |
| | | FATPMEAEL (SEQ ID NO: 242) | Mandic et al. J Immunol. 174(3): 1751-9 (2005). |
| | | FATPMEAELAR (SEQ ID NO: 243) | Chen et al. Proc Natl Acad Sci USA. 101(25): 9363-8 (2004). |
| | | LAMPFATPM (SEQ ID NO: 231) | Ayyoub et al. Clin Cancer Res. 16(18): 4607-15 (2010). |
| | | ARGPESRLL (SEQ ID NO: 232) | Slager et al. J Immunol. 172(8): 5095-102 (2004). |
| | | SLLMWITQCFLPVF (SEQ ID NO: 244) | Mizote et al. Vaccine. 28(32): 5338-46 (2010). |
| | | LLEFYLAMPFATPMEAEL-ARRSLAQ (SEQ ID NO: 245) | Jager et al. J Exp Med. 191(4): 625-30 (2000). Zarour et al. Cancer Res. 60(17): 4946-52 (2000). |
| | | EFYLAMPFATPM (SEQ ID NO: 246) | Zeng et al. J Immunol. 165(2): 1153-9 (2000). |
| | | PGVLLKEFTVSGNILTIRL-TAADHR (SEQ ID NO: 247) | Bioley et al. Clin Cancer Res. 15(13): 4467-74 (2009). |
| | | RLLEFYLAMPFA (SEQ ID NO: 248) | Zarour et al. Cancer Res. 62(1): 213-8 (2002). |
| | | QGAMLAAQERRVPRAAE-VPR (SEQ ID NO: 249) | Hasegawa et al. Clin Cancer Res. 12(6): 1921-7 (2006). |
| | | PFATPMEAELARR (SEQ ID NO: 250) | |
| | | PGVLLKEFTVSGNILTIRLT (SEQ ID NO: 251) | |
| | | VLLKEFTVSG (SEQ ID NO: 252) | |
| | | AADHRQLQLSISSCLQQL (SEQ ID NO: 253) | |
| | | LKEFTVSGNILTIRL (SEQ ID NO: 254) | |
| | | PGVLLKEFTVSGNILTIRL-TAADHR (SEQ ID NO: 247) | |
| | | LLEFYLAMPFATPMEAEL-ARRSLAQ (SEQ ID NO: 245) | |
| | | KEFTVSGNILT (SEQ ID NO: 255) | |
| | | LLEFYLAMPFATPM (SEQ ID NO: 256) | |
| | | AGATGGRGPRGAGA (SEQ ID NO: 257) | |
| 5 | LAGE-1 | MLMAQEALAFL (SEQ ID NO: 233) | Aarnoudse et al. Int J Cancer. 82(3): 442-8 (1999). |
| | | SLLMWITQC (SEQ ID NO: 230) | Rimoldi et al. J Immunol. 165(12): 7253-61 (2000). |
| | | LAAQERRVPR (SEQ ID NO: 236) | Wang et al. J Immunol. 161(7): 3598-606 (1998). |
| | | ELVRRILSR (SEQ ID NO: 314) | Sun et al. Cancer Immunol Immunother. 55(6): 644-52 (2006). |

TABLE 24-continued

| Esophageal cancer | | | |
|---|---|---|---|
| No. | Tumor-associated antigen | Reported immunogenic epitopes | Sources |
| | | APRGVRMAV (SEQ ID NO: 315) | Slager et al. Cancer Gene Ther. 11(3): 227-36 (2004). |
| | | SLLMWITQCFLPVF (SEQ ID NO: 244) | Zeng et al. Proc Natl Acad Sci USA. 98(7): 3964-9 (2001). |
| | | QGAMLAAQERRVPRAAE VP-R (SEQ ID NO: 249) | Slager et al. J Immunol. 172(8): 5095-102 (2004). |
| | | AADHRQLQLSISSCLQQL (SEQ ID NO: 253) | Jager et al. J Exp Med. 191(4): 625-30 (2000). |
| | | CLSRRPWKRSWSAGSCP G-MPHL (SEQ ID NO: 316) | Slager et al. J Immunol. 170(3): 1490-7 (2003). |
| | | ILSRDAAPLPRPG (SEQ ID NO: 317) | Wang et al. Immunity. 20(1): 107-18 (2004). |
| | | AGATGGRGPRGAGA (SEQ ID NO: 257) | Hasegawa et al. Clin Cancer Res. 12(6): 1921-7 (2006). |
| 6 | HERV-K-MEL | MLAVISCAV (SEQ ID NO: 309) | Schiavetti et al. Cancer Res. 62(19): 5510-6 (2002). |
| 7 | KK-LC-1 | RQKRILVNL (SEQ ID NO: 310) | Fukuyama et al. Cancer Res. 66(9): 4922-8 (2006). |
| 8 | KM-HN-1 | NYNNFYRFL (SEQ ID NO: 311) | Fukuyama et al. Cancer Res. 66(9): 4922-8 (2006). |
| | | EYSKECLKEF (SEQ ID NO: 312) | Monji et al. Clin Cancer Res. 10(18 Pt 1): 6047-57 (2004). |
| | | EYLSLSDKI (SEQ ID NO: 313) | |
| 9 | Sp17 | ILDSSEEDK (SEQ ID NO: 299) | Chiriva-Internati et al. Int J Cancer. 107(5): 863-5 (2003). |

TABLE 25

| Brain cancer | | | |
|---|---|---|---|
| No. | Tumor-associated antigen | Reported immunogenic epitopes | Sources |
| 1 | TAG-1 | SLGWLFLLL (SEQ ID NO: 328) | Adair et al. J Immunother. 31(1): 7-17 (2008). |
| | | LSRLSNRLL (SEQ ID NO: 329) | |
| 2 | TAG-2 | LSRLSNRLL (SEQ ID NO: 329) | Adair et al. J Immunother. 31(1): 7-17 (2008). |

TABLE 26

| Pharynx cancer | | | |
|---|---|---|---|
| No. | Tumor-associated antigen | Reported immunogenic epitopes | Sources |
| 1 | TAG-1 | SLGWLFLLL (SEQ ID NO: 328) | Adair et al. J Immunother. 31(1): 7-17 (2008). |
| | | LSRLSNRLL (SEQ ID NO: 329) | |
| 2 | TAG-2 | LSRLSNRLL (SEQ ID NO: 329) | Adair et al. J Immunother. 31(1): 7-17 (2008). |

TABLE 27

| Tumors of the tongue | | | |
|---|---|---|---|
| No. | Tumor-associated antigen | Reported immunogenic epitopes | Sources |
| 1 | TAG-1 | SLGWLFLLL (SEQ ID NO: 328)<br>LSRLSNRLL (SEQ ID NO: 329) | Adair et al. J Immunother. 31(1): 7-17 (2008). |
| 2 | TAG-2 | LSRLSNRLL (SEQ ID NO: 329) | Adair et al. J Immunother. 31(1): 7-17 (2008). |

TABLE 28

| Synovial cell sarcoma | | | |
|---|---|---|---|
| No. | Tumor-associated antigen | Reported immunogenic epitopes | Sources |
| 1 | LAGE-1 | MLMAQEALAFL (SEQ ID NO: 233)<br>SLLMWITQC (SEQ ID NO: 230)<br>LAAQERRVPR (SEQ ID NO: 236)<br>ELVRRILSR (SEQ ID NO: 314)<br>APRGVRMAV (SEQ ID NO: 315)<br>SLLMWITQCFLPVF (SEQ ID NO: 244)<br>QGAMLAAQERRVPRAAE VP-R (SEQ ID NO: 249)<br>AADHRQLQLSISSCLQQL (SEQ ID NO: 253)<br>CLSRRPWKRSWSAGSCP G-MPHL (SEQ ID NO: 316)<br>ILSRDAAPLPRPG (SEQ ID NO: 317)<br>AGATGGRGPRGAGA (SEQ ID NO: 257) | Aarnoudse et al. Int J Cancer. 82(3): 442-8 (1999).<br>Rimoldi et al. J Immunol. 165(12): 7253-61 (2000).<br>Wang et al. J Immunol. 161(7): 3598-606 (1998).<br>Sun et al. Cancer Immunol Immunother. 55(6): 644-52 (2006).<br>Slager et al. Cancer Gene Ther. 11(3): 227-36 (2004).<br>Zeng et al. Proc Natl Acad Sci USA. 98(7): 3964-9 (2001).<br>Slager et al. J Immunol. 172(8): 5095-102 (2004).<br>Jager et al. J Exp Med. 191(4): 625-30 (2000).<br>Slager et al. J Immunol. 170(3): 1490-7 (2003).<br>Wang et al. Immunity. 20(1): 107-18 (2004).<br>Hasegawa et al. Clin Cancer Res. 12(6): 1921-7 (2006). |
| 2 | NY-ESO-1 | HLA-A2-restricted peptide p157-165 (SLLMWITQC (SEQ ID NO: 230)), HLA-Cw3-restricted p92-100 (LAMP-FATPM (SEQ ID NO: 231)) and HLA-Cw6-restricted p80-88 (ARGPESRLL (SEQ ID NO: 232))<br>SLLMWITQC (SEQ ID NO: 230)<br>MLMAQEALAFL (SEQ ID NO: 233)<br>YLAMPFATPME (SEQ ID NO: 234)<br>ASGPGGGAPR (SEQ ID NO: 235)<br>LAAQERRVPR (SEQ ID NO: 236)<br>TVSGNILTIR (SEQ ID NO: 237)<br>APRGPHGGAASGL (SEQ ID NO: 238)<br>MPFATPMEAEL (SEQ ID NO: 239)<br>KEFTVSGNILTI (SEQ ID NO: 240)<br>MPFATPMEA (SEQ ID NO: 241)<br>FATPMEAEL (SEQ ID NO: 242) | Jager et al. Proc. Natl. Acad. Scie. U.S.A. 103(39): 14453-8 (2006).<br>Gnjatic et al. PNAS Sep. 26, 2000 vol. 97 no. 20 p. 10919<br>Jager et al. J Exp Med. 187(2): 265-70 (1998).<br>Chen et al. J Immunol. 165(2): 948-55 (2000).<br>Valmori et al. Cancer Res. 60(16): 4499-506 (2000).<br>Aarnoudse et al. Int J Cancer. 82(3): 442-8 (1999).<br>Eikawa et al. Int J Cancer. 132(2): 345-54 (2013).<br>Wang et al. J Immunol. 161(7): 3598-606 (1998).<br>Matsuzaki et al. Cancer Immunol Immunother. 57(8)1185-95 (2008).<br>Ebert et al. Cancer Res. 69(3): 1046-54 (2009).<br>Eikawa et al. Int J Cancer. 132(2): 345-54 (2013).<br>Knights et al. Cancer Immunol Immunother. 58(3): 325-38 (2009).<br>Jäger et al. Cancer Immun. 2: 12 (2002).<br>Zeng et al. Proc Natl Acad Sci USA. 98(7): 3964-9 (2001).<br>Mandic et al. J Immunol. 174(3): 1751-9 (2005). |

TABLE 28-continued

| Synovial cell sarcoma | | | |
|---|---|---|---|
| No. | Tumor-associated antigen | Reported immunogenic epitopes | Sources |
| | | FATPMEAELAR (SEQ ID NO: 243)<br>LAMPFATPM (SEQ ID NO: 231)<br>ARGPESRLL (SEQ ID NO: 232)<br>SLLMWITQCFLPVF (SEQ ID NO: 244)<br>LLEFYLAMPFATPMEAEL-ARRSLAQ (SEQ ID NO: 245)<br>EFYLAMPFATPM (SEQ ID NO: 246)<br>PGVLLKEFTVSGNILTIRL-TAADHR (SEQ ID NO: 247)<br>RLLEFYLAMPFA (SEQ ID NO: 248)<br>QGAMLAAQERRVPRAAE-VPR (SEQ ID NO: 249)<br>PFATPMEAELARR (SEQ ID NO: 250)<br>PGVLLKEFTVSGNILTIRLT (SEQ ID NO: 251)<br>VLLKEFTVSG (SEQ ID NO: 252)<br>AADHRQLQLSISSCLQQL (SEQ ID NO: 253)<br>LKEFTVSGNILTIRL (SEQ ID NO: 254)<br>PGVLLKEFTVSGNILTIRL-TAADHR (SEQ ID NO: 247)<br>LLEFYLAMPFATPMEAEL-ARRSLAQ (SEQ ID NO: 245)<br>KEFTVSGNILT (SEQ ID NO: 255)<br>LLEFYLAMPFATPM (SEQ ID NO: 256)<br>AGATGGRGPRGAGA (SEQ ID NO: 257) | Chen et al. Proc Natl Acad Sci USA. 101(25): 9363-8 (2004).<br>Ayyoub et al. Clin Cancer Res. 16(18): 4607-15 (2010).<br>Slager et al. J Immunol. 172(8): 5095-102 (2004).<br>Mizote et al. Vaccine. 28(32): 5338-46 (2010).<br>Jager et al. J Exp Med. 191(4): 625-30 (2000).<br>Zarour et al. Cancer Res. 60(17): 4946-52 (2000).<br>Zeng et al. J Immunol. 165(2): 1153-9 (2000).<br>Bioley et al. Clin Cancer Res. 15(13): 4467-74 (2009).<br>Zarour et al. Cancer Res. 62(1): 213-8 (2002).<br>Hasegawa et al. Clin Cancer Res. 12(6): 1921-7 (2006). |
| 3 | HERV-K-MEL | MLAVISCAV (SEQ ID NO: 309) | Schiavetti et al. Cancer Res. 62(19): 5510-6 (2002). |
| 4 | KK-LC-1 | RQKRILVNL (SEQ ID NO: 310) | Fukuyama et al. Cancer Res. 66(9): 4922-8 (2006). |
| 5 | KM-HN-1 | NYNNFYRFL (SEQ ID NO: 311)<br>EYSKECLKEF (SEQ ID NO: 312)<br>EYLSLSDKI (SEQ ID NO: 313) | Fukuyama et al. Cancer Res. 66(9): 4922-8 (2006). |
| 6 | Sp17 | ILDSSEEDK (SEQ ID NO: 299) | Chiriva-Internati et al. Int J Cancer. 107(5): 863-5 (2003). |

TABLE 29

| Neuroblastoma | | | |
|---|---|---|---|
| No. | Tumor-associated antigen | Reported immunogenic epitopes | Sources |
| 1 | LAGE-1 | MLMAQEALAFL (SEQ ID NO: 233)<br>SLLMWITQC (SEQ ID NO: 230) | Aarnoudse et al. Int J Cancer. 82(3): 442-8 (1999).<br>Rimoldi et al. J Immunol. 165(12): 7253-61 (2000). |

TABLE 29-continued

| Neuroblastoma | | | |
|---|---|---|---|
| No. | Tumor-associated antigen | Reported immunogenic epitopes | Sources |
| | | LAAQERRVPR (SEQ ID NO: 236) | Wang et al. J Immunol. 161(7): 3598-606 (1998). |
| | | ELVRRILSR (SEQ ID NO: 314) | Sun et al. Cancer Immunol Immunother. 55(6): 644-52 (2006). |
| | | APRGVRMAV (SEQ ID NO: 315) | Slager et al. Cancer Gene Ther. 11(3): 227-36 (2004). |
| | | SLLMWITQCFLPVF (SEQ ID NO: 244) | Zeng et al. Proc Natl Acad Sci USA. 98(7): 3964-9 (2001). |
| | | QGAMLAAQERRVPRAAE VP-R (SEQ ID NO: 249) | Slager et al. J Immunol. 172(8): 5095-102 (2004). |
| | | AADHRQLQLSISSCLQQL (SEQ ID NO: 253) | Jager et al. J Exp Med. 191(4): 625-30 (2000). |
| | | CLSRRPWKRSWSAGSCP G-MPHL (SEQ ID NO: 316) | Slager et al. J Immunol. 170(3): 1490-7 (2003). |
| | | ILSRDAAPLPRPG (SEQ ID NO: 317) | Wang et al. Immunity. 20(1): 107-18 (2004). |
| | | AGATGGRGPRGAGA (SEQ ID NO: 257) | Hasegawa et al. Clin Cancer Res. 12(6): 1921-7 (2006). |
| 2 | NY-ESO-1 | HLA-A2-restricted peptide p157-165 (SLLMWITQC (SEQ ID NO: 230)), HLA-Cw3-restricted p92-100 (LAMP-FATPM (SEQ ID NO: 231)) and HLA-Cw6-restricted p80-88 (ARGPESRLL (SEQ ID NO: 232)) | Jager et al. Proc. Natl. Acad. Scie. U.S.A. 103(39): 14453-8 (2006). Gnjatic et al. PNAS Sep. 26, 2000 vol. 97 no. 20 p. 10919 Jager et al. J Exp Med. 187(2): 265-70 (1998). Chen et al. J Immunol. 165(2): 948-55 (2000). |
| | | SLLMWITQC (SEQ ID NO: 230) | Valmori et al. Cancer Res. 60(16): 4499-506 (2000). |
| | | MLMAQEALAFL (SEQ ID NO: 233) | Aarnoudse et al. Int J Cancer. 82(3): 442-8 (1999). |
| | | YLAMPFATPME (SEQ ID NO: 234) | Eikawa et al. Int J Cancer. 132(2): 345-54 (2013). |
| | | ASGPGGGAPR (SEQ ID NO: 235) | Wang et al. J Immunol. 161(7): 3598-606 (1998). |
| | | LAAQERRVPR (SEQ ID NO: 236) | Matsuzaki et al. Cancer Immunol Immunother. 57(8)1185-95 (2008). |
| | | TVSGNILTIR (SEQ ID NO: 237) | Ebert et al. Cancer Res. 69(3): 1046-54 (2009). |
| | | APRGPHGGAASGL (SEQ ID NO: 238) | Eikawa et al. Int J Cancer. 132(2): 345-54 (2013). |
| | | MPFATPMEAEL (SEQ ID NO: 239) | Knights et al. Cancer Immunol Imununother. 58(3): 325-38 (2009). |
| | | KEFTVSGNLLTI (SEQ ID NO: 240) | Jäger et al. Cancer Immun. 2: 12 (2002). |
| | | MPFATPMEA (SEQ ID NO: 241) | Zeng et al. Proc Natl Acad Sci USA. 98(7): 3964-9 (2001). |
| | | FATPMEAEL (SEQ ID NO: 242) | Mandic et al. J Immunol. 174(3): 1751-9 (2005). |
| | | FATPMEAELAR (SEQ ID NO: 243) | Chen et al. Proc Natl Acad Sci USA. 101(25): 9363-8 (2004). |
| | | LAMPFATPM (SEQ ID NO: 231) | Ayyoub et al. Clin Cancer Res. 16(18): 4607-15 (2010). |
| | | ARGPESRLL (SEQ ID NO: 232) | Slager et al. J Immunol. 172(8): 5095-102 (2004). |
| | | SLLMWITQCFLPVF (SEQ ID NO: 244) | Mizote et al. Vaccine. 28(32): 5338-46 (2010). |
| | | LLEFYLAMPFATPMEAEL -ARRSLAQ (SEQ ID NO: 245) | Jager et al. J Exp Med. 191(4): 625-30 (2000). Zarour et al. Cancer Res. 60(17): 4946-52 (2000). |
| | | EFYLAMPFATPM (SEQ ID NO: 246) | Zeng et al. J Immunol. 165(2): 1153-9 (2000). |
| | | PGVLLKEFTVSGNILTIRL -TAADHR (SEQ ID NO: 247) | Bioley et al. Clin Cancer Res. 15(13): 4467-74 (2009). |
| | | RLLEFYLAMPFA SEQ ID NO: 248) | Zarour et al. Cancer Res. 62(1): 213-8 (2002). |
| | | QGAMLAAQERRVPRAAE -VPR (SEQ ID NO: 249) | Hasegawa et al. Clin Cancer Res. 12(6): 1921-7 (2006). |
| | | PFATPMEAELARR(SEQ ID NO: 250) | |
| | | PGVLLKEFTVSGNILTIRLT (SEQ ID NO: 251) | |

TABLE 29-continued

| Neuroblastoma | | | |
|---|---|---|---|
| No. | Tumor-associated antigen | Reported immunogenic epitopes | Sources |
| | | VLLKEFTVSG (SEQ ID NO: 252)<br>AADHRQLQLSISSCLQQL (SEQ ID NO: 253)<br>LKEFTVSGNILTIRL (SEQ ID NO: 254)<br>PGVLLKEFTVSGNILTIRL-TAADHR (SEQ ID NO: 247)<br>LLEFYLAMPFATPMEAEL-ARRSLAQ (SEQ ID NO: 245)<br>KEFTVSGNILT (SEQ ID NO: 255)<br>LLEFYLAMPFATPM (SEQ ID NO: 256)<br>AGATGGRGPRGAGA (SEQ ID NO: 257) | |
| 3 | HERV-K-MEL | MLAVISCAV (SEQ ID NO: 309) | Schiavetti et al. Cancer Res. 62(19): 5510-6 (2002). |
| 4 | KK-LC-1 | RQKRILVNL (SEQ ID NO: 310) | Fukuyama et al. Cancer Res. 66(9): 4922-8 (2006). |
| 5 | KM-HN-1 | NYNNFYRFL (SEQ ID NO: 311)<br>EYSKECLKEF (SEQ ID NO: 312)<br>EYLSLSDKI (SEQ ID NO: 313) | Fukuyama et al. Cancer Res. 66(9): 4922-8 (2006).<br>Monji et al. Clin Cancer Res. 10(18 Pt 1): 6047-57 (2004). |
| 6 | Sp17 | ILDSSEEDK (SEQ ID NO: 299) | Chiriva-Internati et al. Int J Cancer. 107(5): 863-5 (2003). |

TABLE 30

| Uterine cancer | | | |
|---|---|---|---|
| No. | Tumor-associated antigen | Reported immunogenic epitopes | Sources |
| 1 | LAGE-1 | MLMAQEALAFL (SEQ ID NO: 233)<br>SLLMWITQC (SEQ ID NO: 230)<br>LAAQERRVPR (SEQ ID NO: 236)<br>ELVRRILSR (SEQ ID NO: 314)<br>APRGVRMAV (SEQ ID NO: 315)<br>SLLMWITQCFLPVF (SEQ ID NO: 244)<br>QGAMLAAQERRVPRAAE VP-R (SEQ ID NO: 249)<br>AADHRQLQLSISSCLQQL (SEQ ID NO: 253)<br>CLSRRPWKRSWSAGSCP G-MPHL (SEQ ID NO: 316)<br>ILSRDAAPLPRPG (SEQ ID NO: 317)<br>AGATGGRGPRGAGA (SEQ ID NO: 257) | Aarnoudse et al. Int J Cancer. 82(3): 442-8 (1999).<br>Rimoldi et al. J Immunol. 165(12): 7253-61 (2000).<br>Wang et al. J Immunol. 161(7): 3598-606 (1998).<br>Sun et al. Cancer Immunol Immunother. 55(6): 644-52 (2006).<br>Slager et al. Cancer Gene Ther. 11(3): 227-36 (2004).<br>Zeng et al. Proc Natl Acad Sci USA. 98(7): 3964-9 (2001).<br>Slager et al. J Immunol. 172(8): 5095-102 (2004).<br>Jager et al. J Exp Med. 191(4): 625-30 (2000).<br>Slager et al. J Immunol. 170(3): 1490-7 (2003).<br>Wang et al. Immunity. 20(1): 107-18 (2004).<br>Hasegawa et al. Clin Cancer Res. 12(6): 1921-7 (2006). |

TABLE 30-continued

| No. | Tumor-associated antigen | Reported immunogenic epitopes | Sources |
|---|---|---|---|
| | | Uterine cancer | |
| 2 | NY-ESO-1 | HLA-A2-restricted peptide p157-165 (SLLMWITQC (SEQ ID NO: 230)), HLA-Cw3-restricted p92-100 (LAMP-FATPM (SEQ ID NO: 231)) and HLA-Cw6-restricted p80-88 (ARGPESRLL (SEQ ID NO: 232))<br>SLLMWITQC (SEQ ID NO: 230)<br>MLMAQEALAFL (SEQ ID NO: 233)<br>YLAMPFATPME (SEQ ID NO: 234)<br>ASGPGGGAPR (SEQ ID NO: 235)<br>LAAQERRVPR (SEQ ID NO: 236)<br>TVSGNILTIR (SEQ ID NO: 237)<br>APRGPHGGAASGL (SEQ ID NO: 238)<br>MPFATPMEAEL (SEQ ID NO: 239)<br>KEFTVSGNILTI (SEQ ID NO: 240)<br>MPFATPMEA (SEQ ID NO: 241)<br>FATPMEAEL (SEQ ID NO: 242)<br>FATPMEAELAR (SEQ ID NO: 243)<br>LAMPFATPM (SEQ ID NO: 231)<br>ARGPESRLL (SEQ ID NO: 232)<br>SLLMWITQCFLPVF (SEQ ID NO: 244)<br>LLEFYLAMPFATPMEAEL-ARRSLAQ (SEQ ID NO: 245)<br>EFYLAMPFATPM (SEQ ID NO: 246)<br>PGVLLKEFTVSGNILTIRL-TAADHR (SEQ ID NO: 247)<br>RLLEFYLAMPFA (SEQ ID NO: 248)<br>QGAMLAAQERRVPRAAE-VPR (SEQ ID NO: 249)<br>PFATPMEAELARR (SEQ ID NO: 250)<br>PGVLLKEFTVSGNILTIRLT (SEQ ID NO: 251)<br>VLLKEFTVSG (SEQ ID NO: 252)<br>AADHRQLQLSISSCLQQL (SEQ ID NO: 253)<br>LKEFTVSGNILTIRL (SEQ ID NO: 254)<br>PGVLLKEFTVSGNILTIRL-TAADHR (SEQ ID NO: 247)<br>LLEFYLAMPFATPMEAEL-ARRSLAQ (SEQ ID NO: 245)<br>KEFTVSGNILT (SEQ ID NO: 255)<br>LLEFYLAMPFATPM (SEQ ID NO: 256)<br>AGATGGRGPRGAGA (SEQ ID NO: 257) | Jager et at. Proc. Natl. Acad. Scie. U.S.A. 103(39): 14453-8 (2006).<br>Gnjatic et al. PNAS Sep. 26, 2000 vol. 97 no. 20 p. 10919<br>Jager et al. J Exp Med. 187(2): 265-70 (1998).<br>Chen et al. J Immunol. 165(2): 948-55 (2000).<br>Valmori et al. Cancer Res. 60(16): 4499-506 (2000).<br>Aarnoudse et al. Int J Cancer. 82(3): 442-8 (1999).<br>Eikawa et al. Int J Cancer. 132(2): 345-54 (2013).<br>Wang et al. J Immunol. 161(7): 3598-606 (1998).<br>Matsuzaki et al. Cancer Immunol Immunother. 57(8)1185-95 (2008).<br>Ebert et al. Cancer Res. 69(3): 1046-54 (2009).<br>Eikawa et al. Int J Cancer. 132(2): 345-54 (2013).<br>Knights et al. Cancer Immunol Immunother. 58(3): 325-38 (2009).<br>Jäger et al. Cancer Immun. 2: 12 (2002).<br>Zeng et al. Proc Natl Acad Sci USA. 98(7): 3964-9 (2001).<br>Mandic et al. J Immunol. 174(3): 1751-9 (2005).<br>Chen et al. Proc Natl Acad Sci USA. 101(25): 9363-8 (2004).<br>Ayyoub et al. Clin Cancer Res. 16(18): 4607-15 (2010).<br>Slager et al. J Immunol. 172(8): 5095-102 (2004).<br>Mizote et al. Vaccine. 28(32): 5338-46 (2010).<br>Jager et al. J Exp Med. 191(4): 625-30 (2000).<br>Zarour et al. Cancer Res. 60(17): 4946-52 (2000).<br>Zeng et al. J Immunol. 165(2): 1153-9 (2000).<br>Bioley et at. Clin Cancer Res. 15(13): 4467-74 (2009).<br>Zarour et al. Cancer Res. 62(1): 213-8 (2002).<br>Hasegawa et al. Clin Cancer Res. 12(6): 1921-7 (2006). |

TABLE 30-continued

| Uterine cancer | | | |
|---|---|---|---|
| No. | Tumor-associated antigen | Reported immunogenic epitopes | Sources |
| 3 | HERV-K-MEL | MLAVISCAV (SEQ ID NO: 309) | Schiavetti et al. Cancer Res. 62(19): 5510-6 (2002). |
| 4 | KK-LC-1 | RQKRILVNL (SEQ ID NO: 310) | Fukuyama et al. Cancer Res. 66(9): 4922-8 (2006). |
| 5 | KM-HN-1 | NYNNFYRFL (SEQ ID NO: 311)<br>EYSKECLKEF (SEQ ID NO: 312)<br>EYLSLSDKI (SEQ ID NO: 313) | Fukuyama et al. Cancer Res. 66(9): 4922-8 (2006).<br>Monji et al. Clin Cancer Res. 10(18 Pt 1): 6047-57 (2004). |
| 6 | Sp17 | ILDSSEEDK (SEQ ID NO: 299) | Chiriva-Internati et al. Int J Cancer. 107(5): 863-5 (2003). |

Gene Alignment

An exemplary alignment of select orthopoxvirus genes is shown below. Various genes of 5 vaccinia virus strains, Copenhagen ("cop"), Western Reserver ("WR"), Tian Tan ("Tian"), Wyeth, and Lister, align as follows:

C2L

CLUSTAL O(1.2.4) multiple sequence alignment (SEQ ID NOS 522-526, respectively, in order of appearance)

```
cop    MESVIFSINGEIIQVNKEIITASPYNFFKRIQDHHLKDEAIILNGINYHAFESLLDYIRW    60
WR     MESVIFSINGEIIQVNKEIITASPYNFFKRIQDHHLKDEAIILNGINYHAFESILDYIRW    60
Tian   MESVIFSINGEIIQVNKEIITASPYNFFKRIQDHHLKDEAIILNGINYHAFESLLDYIRW    60
Wyeth  MESVTFSINGEIIQVNKEIITASPYNFFKRIQEHHINDEVIILNGINYHAFESLLDYMRW    60
Lister MESVIFSINGEIIQVNKEIITASPYNFFKRIQDHHLKDEAIILNGINYHAFESLLDYMRW    60
       **** ***************************:**::**.*****************:**

cop    KKINITINNVEMILVAAIIIDVPPVVDLCVKTMIHNINSTNCIRMFNFSKRYGIKKLYNA    120
WR     KKINITINNVEMILVAAIIIDVPPVVDLCVKTMIHNINSTNCIRMFNFSKRYGIKKLYNA    120
Tian   KKINITINNVEMILVAAIIIDVPPVVDLCVKTMIHNINSTNCIRMFNFSKQYGIKKLYNA    120
Wyeth  KKINITINNVEMILVAAVIIDVTPVVDLCVKTMIHNINSTNCIRMFNESKRYGIKKLYNA    120
Lister KKINITINNVEMILVAAIIIDVPPVVDLCVKTMIHNINFTNCIRMFNFSKRYGIKKLYNA    120
       *****************:**** *************** ***********:*********

cop    SMSEIINNITAVTSDPEFGKLSKDELTTILSHENVNVNHEDVTAMILLKWIHKNPNDVDI    180
WR     SMSEIINNITAVTSDPEFGKLSKDELTTILSHENVNVNHEDVTAMILLKWIHKNPNDVDI    180
Tian   SMSEIINNITAVTSDPEFGKLSKDELTTILSHEDVNVNHEDVTAMILLKWIHKNPNDVDI    180
Wyeth  SMSEIINNITAVTSDPEFGKLSKDELTTILSHEDVNVNHEDVTAMILLKWIHKNPNDVDI    180
Lister SMSEIINNITAVTSDPEFGKLSKDELTTILSHEDVNVNHEDVTAMILLKWIHKNPNDVDI    180
       *********************************:**************************

cop    INILHPKFMTNTMRNAISLLGLTISKSTKPVTRNGIKHNIVVIKNSDYISTITHYSPRTE    240
WR     INILHPKFMTNTMRNAISLLGLTISKSTKPVTRNGIKHNIVVIKNSDYISTITHYSPRTE    240
Tian   INILHPKFMTNTMRNAISLLGLTISKSTKPVTRNGIKHNIVVIKNSDYISTITHYSPRTE    240
Wyeth  INILHPKFMTNTMRNAISLLGLTISKSTKPVTRNGIKHNIVVIKNSDYISTITHYSPRTE    240
Lister INILHPKFMTNTMRNAISLLGLTISKSTKPVTRNGIKHNIVVIKNSDYISTITHYSPRTE    240
       ************************************************************

cop    YWTIVGNTDRQFYNANVLHNCLYIIGGMINNRHVYSVSRVDLETKKWKTVTNMSSLKSEV    300
WR     YWTIVGNTDRQFYNANVLHNCLYIIGGMINNRHVYSVSRVDLETKKWKTVTNMSSLKSEV    300
Tian   YWTIVGNTDRQFYNANVLHNCLYIIGGMINNRHVYSVSRVDLETKKWKTVTNMSSLKSEV    300
Wyeth  YWTIVGNTDRQFYNANVLHNCLYIIGGMINNRHVYSVSRVDLETKKWKTVTNMSSLKSEV    300
Lister YWTIVGNTDRQFYNANVLHNCLYIIGGMINNRHVYSVSRVDLKTKKWKTVTNMSSLKSEV    300
       ******************************************:*****************

cop    STCVNDGKLYVIGGLEFSISTGVAEYLKHGTSKWIRLPNLITPRYSGASVFVNDDIYVMG    360
WR     STCVNDGKLYVIGGLEFSISTGVAEYLKHGTSKWIRLPNLITPRYSGASVFVNDDIYVMG    360
Tian   STCVNNGKLYVIGGLEFSISTGVAEYLKHGTSKWIRLPNLITPRYSGASVFVNDDIYVMG    360
Wyeth  STCVNNGKLYVIGGLEFSISTGVAEYLKHGTSKWIRLPNLITPRYSGASVFVNDDIYVMG    360
Lister STCVNDGKLYVIGGLEFSISTGVAEYLKHGTSKWIRLPNLITPRYSGASVFVNDDIYVMG    360
       *****:******************************************************
```

-continued

```
cop    GVYTTYEKYVVLNDVECFTKNRWIKKSPMPRHHSIVYAVEYDGDIYVITGITHETRNYLY      420
WR     GVYTTYEKYVVLNDVECFTKNRWIKKSPMPRHHSIVYAVEYDGDIYVITGITHETRNYLY      420
Tian   GVYTTYEKYVVLNDVECFTKNRWIKKSPMPRHHSIVYAVEYDGDIYVITGITHETRNYLY      420
Wyeth  GVYTTYEKYVVLNDVECFTKNRWIKKSPMPRHHSIVYAVEYDGDIYAITGITHETRNYLY      420
Lister GVYTTYEKYVVLNDVECFTKNRWIKKSPMPRHHSIVYAVEYDGDIYVITGITHETRNYLY      420
       **********************************************.*************

cop    KYIVKEDKWIELYMYFNHVGKMFVCSCGDYILIIADAKYEYYPKSNTWNLFDMSTRNIEY      480
WR     KYIVKEDKWIELYMYFNHVGKMFVCSCGDYILIIADAKYEYYPKSNTWNLFDMSTRNIEY      480
Tian   KYIVKEDKWIELYMYFNHVGKMFVCSCGDYILIIADAKYEYYPKSNTWNLFDMSTRNIEY      480
Wyeth  KYIVKEDKWIELYMYFNHVGKMFVCSCGDYILIIADAKYEYYPKSNTWNLFDMSTRNIEY      480
Lister KYIVKEDKWIELYMYFNHVGKMFVCSCGDYILIIADAKYEYYPKSNTWNLFDMSTRNIEY      480
       ************************************************************

cop    YDMFTKDETPKCNVTHKSLPSFLSNCEKQFLQ                                  512
WR     YDMFTKDETPKCNVTHKSLPSFLSNCEKQFLQ                                  512
Tian   YDMFTKDETPKCNVTHKSLPSFLSNCEKQFLQ                                  512
Wyeth  YDMFTKDET------HKSLPSFLSNCEKQFLQ                                  506
Lister YDMFTKDETPKCNVTHKSLPSFLSNCEKQFLQ                                  512
       *********      *****************
```

c1L

CLUSTAL O(1.2.4) multiple sequence alignment (SEQ ID NOS 527-531, respectively, in order of appearance)

```
Cop    MVKNNKI-----SNSCRMIMSTNPNNILMRHLKNLTDDEFKCIIHRSSDFLYLSDSDYTS       55
WR     MVKNNKIQKNKISNSCRMIMSTDPNNILMRHLKNLTDDEFKCIIHRSSDFLYLSDSDYTS       60
Tian   MVKNNKI-----SNSCRMIMSTDPNNILMRHLKNLTDDEFKCIIHRSSDFLYLSDSDYTS       55
Wyeth  MVKNNKI-----SNSCRMIMSTNPNNILMRHLKNLTDDEFKCIIHRSSDFLYLSDRDYTS       55
Lister MVKNNKI-----SNSCRMIMSTNPNNILMRHLKNLTDDEFKCIIHRSSDFLYLSDSDYTS       55
       *******     ************************************************

Cop    ITKETLVSEIVEEYPDDCNKILAIIFLVLDKDIDVDIETKLKPKPAVRFAILDKMTEDIK      115
WR     ITKETLVSEIVEEYPDDCNKILAIIFLVLDKDIDVDIKTKLKPKPAVRFAILDKMTEDIK      120
Tian   ITKETLVSEIVEEYPDDCNKILAIIFLVLDKDIDVDIKTKLKPKPAVRFAILDKMTEDIK      115
Wyeth  ITKETLVSEIVEEYPDDCNKILAIIFLVLDKDIDVDIKTKLKPKPAVRFAILDKMTEDIK      115
Lister ITKETLVSEIVEEYPDDCNKILAIIFLVLDKDIDVDIETKLKPKPAVRFAILDKMTADIK      115
       **************************************:***************** ***

Cop    LTDLVRHYFRYIEQDIPLGPLFKKIDSYRTRAINKYSKELGLATEYFNKYGHLMFYTLPI      175
WR     LTDLVRHYFRYIEQDIPLGPLFKKIDSYRTRAINKYSKELGLATEYFNKYGHLMFYTLPI      180
Tian   LTDLVRHYFRYIEQDIPLGPLFKKIDSYRTRAINKYSKELGLATEYFNKYGHLMFYTLPI      175
Wyeth  LTDLVRHYFRYIEQDIPLGPLFKKIDSYRTRAINKYSKELGLATEYFNKYGHLMFYTLPI      175
Lister LTDLVRHYFRYIEQDIPLGPLFKKIDSYRTRAINRYSKELGLATEYFNKYGHLMFYTLPI      175
       ************************************************************

Cop    PYNRFFCRNSIGFLAVLSPTIGHVKAFYKFIEYVSIDDRRKFKKELMSK                 224
WR     PYNRFFCRNSIGFLAVLSPTIGHVKAFYKFIEYVSIDDRRKFKKELMSK                 229
Tian   PYNRFFCRNSIGFLAVLSPTIGHVKAFYKFIEYVSIDDRRKFKKELMSK                 224
Wyeth  PYNRFFCRNSIGFLAVLSPTIGHVKAFYKFIEYVSIDDRRKFKKELMSK                 224
Lister PYNRFFCRNSIGFLAVLSPTIGHVKAFYRFIEYVSIDDRRKFKKELMSK                 224
       *************************************************
```

N1L

CLUSTAL O(1.2.4) multiple sequence alignment (SEQ ID NOS 532-536, respectively, in order of appearance)

```
Cop    MRTLLIRYILWRNDNDQTYYNDDFKKLMLLDELVDDGDVCTLIKNMRMTLSDGPLLDRLN       60
WR     MRTLLIRYILWRNDNDQTYYNDNFKKLMLLDELVDDGDVCTLIKNMRMTLSDGPLLDRLN       60
Tian   MRTLLIRYILWRNDNDQTYYNDDFKKLMLLDELVDDGDVCTLIKNMRMTLSDGPLLDRLN       60
Wyeth  MRTLLIRYILWRNDNDQTYYNDDFKKLMLLDELVDDGDVCTLIKNMRMTLSDGPLLDRLN       60
Lister MRTLLIRYILWRNDNDQTYYNDDFKKLMLLDELVDDGDVCTLIKNMRMTLSDGPLLDRLN       60
       *********************:**************************************

Cop    QPVNNIEDAKRMIAISAKVARDIGERSEIRWEESFTILFRMIETYFDDLMIDLYGEK        117
WR     QPVNNIEDAKRMIAISARVARDIGERSEIRWEESFTILFRMIETYFDDLMIDLYGEK        117
Tian   QPVNNIEDAKRMIAISAKVARDIGERSEIRWEESFTILFRMIETYFDDLMIDLYGEK        117
Wyeth  QPVNNIEDAKRMIAISARVARDIGERSEIRWEESFTILFRMIETYFDDLMIDLYGEK        117
Lister QPVNNIEDAKRMIAISAKVARDIGERSEIRWEESFTILFRMIETYFDDLMIDLYGEK        117
       *********************************************************
```

-continued

N2L

CLUSTAL O(1.2.4) multiple sequence alignment (SEQ ID NOS 537-541, respectively, in order of appearance)

```
Cop    MTSSAMDNNEPKVLEMVYDATILPEGSSMDPNIMDCINRHINMCIQRTYSSSIIAILNRF     60
WR     MTSSANDNNEPKVLEMVYDATILPEGSSMDPNIMDCINRHINMCIQRTYSSSIIAILDRF     60
Tian   MTSSAMDNNEPKVLEMVYDATILPEGSSMDPYIMDCINRHINMCIQRTYSSSIIAILDRF     60
Wyeth  MTSSAMDNNEPKVLEMVYDATILPEGSSMDPNIIDCINRHINMCIQRTYSSSIIAILDRF     60
Lister MTSSAMDNNEPKVLEMVYDATILPEGSSMDPNIMDCINRHINMCIQRTYSSSIIAILDRF     60
       ******************************* *:***********************:**

Cop    LTMNKDELNNTQCHIIKEFMTYEQMAIDHYGEYVNAILYQIRKRPNQHHTIDLFKKIKRT    120
WR     LMMNKDELNNTQCHIIKEFMTYEQMAIDHYGGYVNAILYQIRKRPNQHHTIDLFKRIKRT    120
Tian   LMMNKDELNNTQCHIIKNL-----------------------------------------     79
Wyeth  LTMNKDELNNTQCHIIKEFMTYEQMAIDHYGGYVNAILYQIRKRPNQHHTIDLFKKIKRT    120
Lister LTMNRDELNNTQCHIIKEFMTYEQMAIDHYGEYVNAILYQIRKRPNQHHTIDLFKKIKRT    120
       * ***************::

Cop    PYDTFKVDPVEFVKKVIGFVSILNKYKPVYSYVLYENVLYDEFKCFINYVETKYF         175
WR     RYDTFKVDPVEFVKKVIGFVSILNKYKPVYSYVLYENVLYDEFKCFINYVETKYF         175
Tian   -------------------------------------------------------
Wyeth  RYDTFKVDPVEFVKKVIGFVSILNKYKPVYSYVLYENVLYDEFKCFIDYVETKYF         175
Lister RYDTFKVDPVEFVKKVIGFVSILNKYKPVYSYVLYENVLYDEFKCFIDYVETKYF         175
```

M1L

CLUSTAL O(1.2.4) multiple sequence alignment (SEQ ID NOS 542-546, respectively, in order of appearance)

```
Cop    MIFVIESKLLQIYRNRNRNINFYTTMDNIMSAEYYLSLYAKYNSKNLDVFRNMLQAIEPS     60
WR     MIFVIESKLLQIYRNRNRNINFYTTMDNIMSAEYYLSLYAKYNSKNLDVFRNMLQAIEPS     60
Tian   MIFVIESKLLQIYRNRNRNINFYTTMDNIMSAEYYLSLYAKYNSKNLDVFRNMLQAIEPS     60
Wyeth  MIFVIESKLLQIYRNRNRNINFYTTMDNIMSAEYYLSLYAKYNSKNLDVFRNMLQAIEPS     60
Lister MIFVIESKLLQIYRN--RNINFYTTMDNIMSAEYYLSLYAKYNSKNLDVFRNMLQAIEPS     58
       ***************  *******************************************

Cop    GNNYHILHAYCGIKGLDERFVEELLHRGYSPNETDDDGNYPLHIASKINNNRIVAMLLTH    120
WR     GNNYHILHAYCGIKGLDERFVEELLHRGYSPNETDDDGNYPLHIASKINNNRIVAMLLTH    120
Tian   GNNYHILHAYCGIKGLDERFVEELLHRGYSPNETDDDGNYPLHIASKINNNRIVAMLLTH    120
Wyeth  GNNYHILHAYCGIKGLDERFVEELLHRGYSPNETDDDGNYPLHIASKINNNRIVAMLLTH    120
Lister GNNYHILHAYCGIKGLDERFVEELLHRGYSPNETDDDGNYPLHIASKINNNRIVAMLLTH    118
       ************************************************************

Cop    GADPNACDKHNKTPLYYLSGTDDEVIERINLLVQYGAKINNSVDEEGCGPLLACTDPSER    180
WR     GADPNACDKHNKTPLYYLSGTDDEVIERINLLVQYGAKINNSVDEEGCGPLLACTDPSER    180
Tian   GADPNACDKHNKTPLYYLSGTDDEVIERINLLVQYGAKINNSVDEEGCGPLLACTDPSER    180
Wyeth  GADPNACDKHNKTPLYYLSGTDDEVIERINLLVQYGAKINN-------------------    161
Lister GADPNACDKQHKTPLYYLSGTDDEVIERINLLVQYGAKINNSVDEEGCGPLLACTDPSER    178
       *********::******************************

Cop    VFKKIMSIGFEARIVDKFGKNHIHRHLMSDNPKASTISWMMKLGISPSKPDHDGNTPLHI    240
WR     VFKKIMSIGFEARIVDKFGKNHIHRHLMSDNPKASTISWMMKLGISPSKPDHDGNTPLHI    240
Tian   VFKKIMSIGFEARIVDKFGKNHIHRHLMSDNPKASTISWMMKLGISPSKPDHDGNTPLHI    240
Wyeth  ------------------------------------------------------------
Lister VFKKIMSIGFEARIVDKFGKNHIHRHLMSDNPKASTISWMMKLGISPSKPDHDGNTPLHI    238

Cop    VCSKTVKNVDIIDLLLPSTDVNKQNKFGDSPLTLLIKTLSPAHLINKLLSTSNVITDQTV    300
WR     VCSKTVKNVDIIDLLLPSTDVNKQNKFGDSPLTLLIKTLSPAHLINKLLSTSNVITDQTV    300
Tian   VCSKTVKNVDIIDLLLPSTDVNKQNKFGDSPLTLLIKTLSPAHLINKLLSTSNVITDQTV    300
Wyeth  ------------------------------------------------------------
Lister VCSKTVKNVDIIDLLLPSTDVNKQNKFGDSPLTLLIKTLSPAHLINKLLSTSNVITDQTV    298

Cop    NICIFYDRDDVLEIINDKGKQYDSTDFKMAVEVGSIRCVKYLLDNDIICEDAMYYAVLSE    360
WR     NICIFYDRDDVLEIINDKGKQYDSTDFKMAVEVGSIRCVKYLLDNDIICEDAMYYAVLSE    360
Tian   NICIFYDRDDVLEIINDKGKQYDSTDFKMAVEVGSIRCVKYLLDNDIICEDAMYYAVLSE    360
Wyeth  ------------------------------------------------------------
Lister NICIFYDRDDVLEIINDKGKQYDSTDFKMAVEVGSIRCVKYLLDNDIICEDAMYYAVLSE    358

Cop    YETMVDYLLFNHFSVDSVVNGHTCMSECVRLNNPVILSKLMLHNPTSETMYLTMKAIEKD    420
WR     YETMVDYLLFNHFSVDFVVNGHTCMSECVRLNNPVILSKLMLHNPTSETMYLTMKAIEKD    420
Tian   YETMVDYLLFNHFSVDFVVNGHTCMSECVRLNNPVILSKLMLHNLTSETMYLTMKAIEKD    420
Wyeth  ------------------------------------------------------------
Lister YETMVDYLLENHFSVDSVVNGHTCMSECVRLNNPVILSKLMLHNPTSETMYLTMKAIEKD    418

Cop    KLDKSIIIPFIAYFVLMHPDFCKNRRYFTSYKRFVTDYVHEGVSYEVFDDYF            472
WR     RLDKSIIIPFIAYFVLMHPDFCKNRRYFTSYKRFVTDYVHEGVSYEVFDDYF            472
Tian   RLDKSIIIPFIAYFVLMHPDFCKNRRYFTSYKRFVTDYVHEGVSYEVFDDYF            472
Wyeth  ----------------------------------------------------
Lister RLDKSIIIPFIAYFVLMHPDFCKNRRYFTSYKRFVTDYVHEGVSYEVFDDYF            470
```

-continued

M2L
CLUSTAL O(1.2.4) multiple sequence alignment (SEQ ID NOS 547-551, respectively, in order of appearance)

```
Cop    MVYKLVLLFCIASLGYSVEYKNTICPPRQDYRYWYFAAELTIGVNYDINSTIIGECHMSE     60
WR     MVYKLVLLFCIASLGYSVEYKNTICPPRQDYRYWYFAAELTIGVNYDINSTIIGECHMSE     60
Tian   ------------------------MSSSTRLPVLVLAAELTIGVNYDINSTIIGECHMSE     36
Wyeth  MVYKLVLLFCIASLGYSVEYKNTICPPRQDYRYWYFAAELTIGVNYDINSTIIGECHMSE     60
Lister MVYKLVLLFCIASLGYSVEYKNTICPPRQDYRYWYFAAELTIGVNYDINSTIIGECHMSE     60
                                          :************************

Cop    SYIDRNANIVLIGYGLEINMTIMDTDQREVAAAEGVGKDNKLSVLLFTTQRLDKVHHNIS    120
WR     SYIDRNANIVLTGYGLEINNTIMDTDQRFVAAAEGVGKDNKLSVLLFTTQRLDKVHHNIS    120
Tian   SYIDRNANIVLTGYGLEINMTIMDTDQRFVAAAEGVGKDNKLSVLLFTTQRLDKVHHNIS     96
Wyeth  SYIDRNANIVLTGYGLEINMTIMDTDQRFVAAAEGVGKDNKLSVLLFTTQRLDKVHHNIS    120
Lister SYIDRNANIVLTGYGLEINMTIMDTDQRFVAAAEGVGKDNKLSVLLFTTQRLDKVHHNIS    120
       ************************************************************

Cop    VTITCMEMNCGTTKYDSDLPESIHKSSSCDITINGSCVTCVNLETDPTKINPHYLHPKDK    180
WR     VTITCMEMNCGTTKYDSDLPESIHKSSSCDITINGSCVTCVNLETDPTKINPHYLHPKDK    180
Tian   VTITCMEMNCGTTKYDSDLPESIHKSSSCDITINGSCVTCVNLETDPTKINPHYLHPKDK    156
Wyeth  VTITCMEMNCGTTKYDSDLPESIHKSSSCDITINGSCVTCVNLETDPTKINPHYLHPKDK    180
Lister VTITCMEMNCGTTKYDSDLPESIHKSSSCDITINGSCVTCVNLETDPTKINPHYLHPKDK    180
       ************************************************************

Cop    YLYHNSEYGMRGSYGVTFIDELNQCLLDIKELSYDICYRE                        220
WR     YLYHNSEYSMRGSYGVTFIDELNQCLLDIKELSYDICYRE                        220
Tian   YLYHNSEYGMRGSYGVTFIDELNQCLLDIKELSYDICYRE                        196
Wyeth  YLYHNSEYGMRGSYGVTFIDELNQCLLDIKELSYDICYRE                        220
Lister YLYHNSEYGMRGSYGVTFIDELNQCLLDIKELSYDICYRE                        220
       ********_*******************************
```

K1L
CLUSTAL O(1.2.4) multiple sequence alignment (SEQ ID NOS 552-556, respectively, in order of appearance)

```
Cop    MDLSRINTWKSKQLKSFLSSKDTFKADVHGHSALYYAIADNNVRLVCTLLNAGALKNLLE     60
WR     MDLSRINTWKSKQLKSFLSSKDAFKADVHGHSALYYAIADNNVRLVCTLLNAGALKNLLE     60
Tian   MDLSRINTWKSKQLKSFLSSKDTFKADVHGHSALYYAIADNNVRLVCTLLNSGALKNLLE     60
Wyeth  MDLSRINTWKSKQLKSFLSSKDTFKADVHGHSALYYAIADNNVRLVCTLLNAGALKNLLE     60
Lister MDLSRINTWKSKQLKSFLSSKDAFKADINGHSALYYAIADNNVRLVCTLLNAGALKNLLE     60
       **********************:****::**********************:********

Cop    NEFPLHQAATLEDTKIVKILLFSGMDDSQFDDKGNTALYYAVDSGNMQTVKLFVKKNWRL    120
WR     NEFPLHQAATLEDTKIVKILLFSGLDDSQFDDKGNTALYYAVDSGNMQTVKLFVKKNWRL    120
Tian   NEFPLHQAATLEDTKIVKILLFSGLDDSQFDDKGNTALYYAVDSGNMQTVKLFVKKNWRL    120
Wyeth  NEFPLHQAATLEDTKIVKILLFSGLDDSQFDDKGNTALYYAVDSGNMQTVKLFVKKNWRL    120
Lister NEFPLHQAATLEDTKIVKILLFSGLDDSQFDDKGNTALYYAVDSGNMQTVKLFVKKNWRL    120
       ************************:***********************************

Cop    MFYGKTGWKTSFYHAVMLNDVSIVSYFLSEIPSTFDLAILLSCIHTTIKNGHVDMMILLL    180
WR     MFYGKTGWETSFYHAVMLNDVSIVSYFLSEIPSTFDLAILLSCIHITIKNGHVDMMILLL    180
Tian   MFYGKTGWKTSFYHAVMLNDVSIVSYFLSEIPSTFDLAILLSCIHITIKNGHVDMMILLL    180
Wyeth  MFYGKTGWKTSFYHAVMLNDVSIVSYFLSEIPSTFDLAILLSCIHITIKNGHVDMMILLL    180
Lister MFYGKTGWKTSFYHAVMLNDVSIVSYFLSEIPSTFDLAILLSCIHITIKNGHVDMMILLL    180
       ********************************************* **************

Cop    DYMTSTNTNNSLLFIPDIKLAIDNKDIEMLQALFKYDINIYSVNLENVLLDDAEITKMII    240
WR     DYMTSTNTNNSLLFIPDIKLAIDNKDIEMLQALFKYDINIYSANLENVLLDDAEIAKMII    240
Tian   DYMTVDKHQ---------------------------------------------------    189
Wyeth  DYMTSTNTNNSLLFIPDIKLAIDNKDIEMLQALFKYDINIYSANLENVLLDDAEIAKMII    240
Lister DYMTSTNTNNSLLFIPDIKLAIDNKDIEMIQALFKYDINIYSANLENVLLDDAEIAKMII    240
       ****  : :

Cop    EKHVEYKSDSYTKDLDIVKNNKLDEIISKNKELRLMYVNCVKKN                    284
WR     EKHVEYKSDSYTKDLDIVKNNKLDEIISKNKELRLMYVNCVKKN                    284
Tian   --------------------------------------------
Wyeth  EKHVEYKSDSYTKDLDIVKNNKLDEIISKNKELRLMYVNCVKKN                    284
Lister EKHVEYKSDSYTKDLDIVKNNKLDEIISKNKELKLMYVNCVKKN                    284
```

-continued

K2L

CLUSTAL O(1.2.4) multiple sequence alignment (SEQ ID NOS 557-561, respectively, in order of appearance)

```
Cop    MIALLILSLTCSVSTYRLQGFTNAGIVAYKNIQDDNIVFSPFGYSFSMFMSLLPASGNTR      60
WR     MIALLILSLTCSVSTYRLQGFTNAGIVAYKNIQDDNIVFSPFGYSFSMFMSLLPASGNTR      60
Tian   MIALLILSLACSASAYRLQGFTNAGIVAYKNIQDDNIVFSPFGYSFSMFMSLLPASGNTR      60
Wyeth  MIALLILSLTCSVSTYRLQGFTNAGIVAYKNIQDDNIVFSPFGYSFSMFMSLLPASGNTR      60
Lister ------------------------------------------------------------

Cop    IELLKTMDLRKRDLGPAFTELISGLAKLKTSKYTYTDLTYQSFVDNTVCIKPLYYQQYHR     120
WR     IELLKTMDLRKRDLGPAFTELISGLAKLKTSKYTYTDLTYQSFVDNTVCIKPSYYQQYHR     120
Tian   IELLKTMDLRKRDLGPAFTELISGLAKLKTSKYTYTDLTYQSFVDNTVCIKPSYYQQYHR     120
Wyeth  IELLKTMDLRKRDLGPAFTELISGLAKLKTSKYTYTDLTYQSFVDNTVCIKPSYYQQYHR     120
Lister IELLKTMDLRKRDLGPAFTELISGLAKLKTSKYTYTDLTYQSFVDNTVCIKPSYYQQYHR      60
       **************************************************** *******

Cop    FGLYRLNFRRDAVNKINSIVERRSGMSNVVDSNMLDNNTLWAIINTIYFKGTWQYPFDIT     180
WR     FGLYRLNFRRDAVNKINSIVERRSGMSNVVDSNMLDNNTLWAIINTIYFKGIWQYPFDIT     180
Tian   FGLYRLNFRRDAVNKINSIVERRSGMSNVVDSNMLDNNTLWAIINTIYFKGTWQYPFDIT     180
Wyeth  -----LNFRRDAVNKINSIVERRSGMSNVVDSNMLDNNTLWAIINTIYFKGIWQYPFDIT     175
Lister FGLYRLNFRRDAVNKINSIVERRSGMSNVVDSNMLDNNTLWAIINTIYFKGIWQYPFDIT     120
            ********************************************* ********

Cop    KTRNASFTNKYGTKTVPMMNVVTKLQGNTITIDDEEYDMVRLPYKDANISMYLAIGDNMT     240
WR     KTRNASFTNKYGTKTVPMMNVVTKLQGNTITIDDEEYDMVRLPYKDANISMYLAIGDNMT     240
Tian   KTRNASFTNKYGTKTVPMMNVVTKLQGNTITIDDEEYDMVRLPYKDANISMYLAIGDNMT     240
Wyeth  KTRNASFTNKYGTKTVPMMNVVTKLQGNTITIDDKEYDMVRLPYKDANISMYLAIGDNMT     235
Lister KTRNASFTNKYGTKTVPMMNVVTKLQGNTITIDDEEYDMVRLPYKDANISMYLAIGDNMT     180
       **********************************:*************************

Cop    HFTDSITAAKLDYWSFQLGNKVYNLKLPKFSIENKRDIKSIAEMMAPSMFNPDNASFKHM     300
WR     HFTDSITAAKLDYWSFQLGNKVYNLKLPKFSIENKRDIKSIAEMMAPSMENPDNASFKHM     300
Tian   HFTDSITAA-KDYWSFQLGNKVYNLKLPKFSIENKRDIKSIAEMMAPSMFNPDNASFKHM     299
Wyeth  HFTDSITAAKLDYWSFQLGNKVYNLKLPKFSIENKRDIKSIAEMMAPSMFNPDNASFKHM     295
Lister HFTDSITAAKLDYWSSQLGNKVYNLKLPKFSIENKRDIKSIAEMMAPSMFNPDNASFKHM     240
       *********  **** *******************************************

Cop    TRDPLYIYKMFQNAKIDVDEQGTVAEASTIMVATARSSPEKLEFNTPFVFIIRHDITGFI     360
WR     TRDPLYIYKMFQNAKIDVDEQGTVARASTIMVATARSSPEKLEFNTPFVFIIRHDITGFI     360
Tian   TRDPLYIYKMFQNAKIDVDEQGTVAEASTIMVATARSSPEELEFNTPFVFIIRHDITGFI     359
Wyeth  TRDPLYIYKMFQNAKIDVDEQGTVAEASTIMVATARSSPEKLEFNTPFVFIIRHDITGFI     355
Lister TRDPLYIYKMFQNAKIDVDEQGTVAEASTIMVATARSSPEKLEFNTPFVFIIRHDITGFI     300
       ************************************************************

Cop    LFMGKVESP                                                        369
WR     LFMGKVESP                                                        369
Tian   LFMGKVESP                                                        368
Wyeth  LFMGKVESP                                                        364
Lister LFMGKVESP                                                        309
       *********
```

K ORF A

CLUSTAL O(1.2.4) multiple sequence alignment (SEQ ID NOS 562-563, respectively, in order of appearance)

```
Cop    MGHIITYCQVHTNISILIRKAHHIIFFVIDCDCISLQFSNYVHHGNRFRTVLISKTSIAC      60
Tian   MGHIITYCQVHTNISILIRKAYHIIFFVIDCDCISLQFSNYVHHGNRFRTVLISKTSIAC      60
       *********************:**************************************

Cop    FSDIKRILPCTFKIYSINDCP                                             81
Tian   FSDIKRILPCTFKIYSINDCP                                             81
        *********************
```

K3L

CLUSTAL O(1.2.4) multiple sequence alignment (SEQ ID NOS 564-568, respectively, in order of appearance)

```
Cop    MLAFCYSLPNAGDVIKGRVYEKDYALYIYLFDYPHSEAILAESVKMHMDRYVEYRDKLVG      60
WR     MLAFCYSLPNAGDVIKGRVYEKDYALYIYLFDYPHFEAILAESVKMHMDRYVEYRDKLVG      60
Tian   MLAFCYSLPNAGDVIKGRVYEKDYALYIYLFDYPHSEAILAESVKMHMDRYVEYRDKLVG      60
Wyeth  MLAFCYSLPNAGDVIKGRVYENDYALYIYLFDYPHFEAILAESVKMHMDRYVEYRDXLVG      60
Lister MLAFCYSLPNAGDVIKGRVYENDYALYIYLFDYPHSEAILAESVKMHMDRYVEYRDKLVG      60
       *********************:************* ************************
```

-continued

```
Cop    KTVKVKVIRVDYTKGYIDVNYKRMCRHQ                                   88
WR     KTVKVKVIRVDYTKGYIDVNYKRMCRHQ                                   88
Tian   KTVKVKVIRVDYTKGYIDVNYKRMCRHQ                                   88
Wyeth  KTVKVKVIRVDYTKGYIDVNYKRMCRHQ                                   88
Lister KTVKVKVIRVDYTKGYIDVNYKRMCRHQ                                   88
       ****************************
```

K4L

CLUSTAL O(1.2.4) multiple sequence alignment (SEQ ID NOS 569-572, respectively, in order of appearance)

```
Cop    MNPDNTIAVITETIPIGMQFDKVYLSTFNMWREILSNTTKTLDISSFYWSLSDEVGTNFG   60
WR     MNPDNTIAVITETIPIGMQFDKVYLSTFNMWREILSNTTKTLDISSFYWSLSDEVGTNFG   60
Wyeth  MNPDNTIAVITETIPIGMQFDKVYLSTFNMWREILSNTTKTLDISSFYWSLSDEVGTNFG   60
Lister MNPDNTIAVITETIPIGMQFDKVYLSTFNMWREILSNTTKTLDISSFYWSLSDEVGTNFG   60
       ************************************************************

Cop    TIILNEIVQLPKRGVRVRVAVNKSNKPLKDVERLQMAGVEVRYIDITNILGGVLHTKFWI   120
WR     TIILNKIVQLPKRGVRVRVAVNKSNKPLKDVERLQMAGVEVRYIDITNILGGVLHTKFWI   120
Wyeth  TIILNEIVQLPKRGVRVRVAVNKSNKPLKDVERLQMAGVEVRYIDITNILGGVLHTKFWI   120
Lister TIILNEIVQLPKRGVRVRVAVNKSNKPLKDVERLQMAGVEVRYIDITNILGGVLHTKFWI   120
       *****:******************************************************

Cop    SDNTHIYLGSANMDWRSLTQVKELGIAIFNNRNLAADLTQIFEVYWYLGVNNLPYNWKNF   180
WR     SDNTHIYLGSANMDWRSLTQVKELGIAIFNNRNLAADLTQIFEVYWYLGVNNLPYNWKNF   180
Wyeth  SDNTHIYLGSANMDWRSLTQVKELGIAIFNNRNLAADLIQIFEVYWYLGVNNLPYNWKNF   180
Lister SDNTHIYLGSANMDWRSLTQVKELGIAIFNNRNLAADLIQIFEVYWYLGVNNLPYNWKNF   180
       ************************************************************

Cop    YPSYYNTDHPLSINVSGVPHSVFIASAPQQLCTMERTNDLTALLSCIRNASKFVYVSVMN   240
WR     YPSYYNTDHPLSINVSGVPHSVFIASAPQQLCTMERTNDLTALLSCIRNASKFVYVSVMN   240
Wyeth  YPSYYNTDHPLSINVSGVPHSVFIASAPQQLCTMERTNDLTALLSCIRNASKFVYVSVMN   240
Lister YPSYYNTDHPLSINVSGVPHSVFIASAPQQLCTMERTNDLTALLSCIRNASKFVYVSVMN   240
       ************************************************************

Cop    FIPIIYSKAGKILFWPYIEDELRRSAIDRQVSVKLLISCWQRSSFIMRNFLRSIAMLKSK   300
WR     FIPIIYSKAGNILFWPYIEDELRRAAIDRQVSVKLLISCWQRSSFIMRNFLRSIAMLKSK   300
Wyeth  FIPIIYSKAGKILFWPYIEDELRRSAIDRQVSVKLLISCWQRSSFIMRNFLRSIAMLKSK   300
Lister FIPIIYSKAGKILFWPYIEDELRRSAIDRQVSVKLLISCWQRSSFIMRNFLRSIAMLKSK   300
       **********:*************:***********************************

Cop    NIDIEVKLFIVPDADPPIPYSRVNHAKYMVTDKTAYIGTSNWTGNYFTDTCGASINITPD   360
WR     NINIEVKLFIVPDADPPIPYSRVNEAKYMVTDKTAYIGTSNWTGNYFTDTCGASINITPD   360
Wyeth  NINIEVKLFIVPDADPPIPYSRVNHAKYMVTDKTAYIGTSNWTGNYFTDTCGASINITPD   360
Lister NINIEVKLFIVPDADPPIPYSRVNHAKYMVTDKTAYIGTSNWTGNYFTDTCGASINITPD   360
       **:*********************************************************

Cop    DGLGLRQQLEDIFMRDWNSKYSYELYDTSPTKRCKLLKNMKQCTNDIYCDEIQPEKEIPE   420
WR     DGLGLRQQLEDIFMRDWNSKYSYELYDTSPTKRCRLLKNMKQCTNDIYCDEIQPEKEIPE   420
Wyeth  DGLGLRQQLEDIFMRDWNSKYSYELYDTSPTKRCKLLKNMKQCTNDIYCDEIQPEKEIPE   420
Lister DGLGLRQQLEDIFMRDWNSKYSYELYDTSPTKRCKLLKNMKQCTNDIYCDEIQPEKEIPE   420
       **********************************:*************************   420

Cop    YSLE                                                           424
WR     YSLE                                                           424
Wyeth  YSLE                                                           424
Lister YSLE                                                           424
       ****
```

K5L

CLUSTAL O(1.2.4) multiple sequence alignment (SEQ ID NOS 573-577, respectively, in order of appearance)

```
Cop    -------------MGATISILASYDNPNLFTAMILMSPLVNADAVSRLNLLAAKLMGTIT   47
WR     MTLVQHVVTIKSTYWVIPWELASYDNPNLFTAMILMSPLVNADAVSKLNLLAAKINGTIT   60
Tian   MTLVQHVVTIKSTYWVIPWELASYDNPNLFTAMILMSPLVNADAVSKLNLLAAKLMGTIT   60
Wyeth  -------------MGATISILASYDNPNLFTAMILMSPLVNADAVSKLNLLAAKLMGTIT   47
Lister ---------MGHSMGATISILASYDNPNLFTAMILMSPLVNADAVSRINLLAAKLMGTIT   51
                           **************************:*************

Cop    PNAPVGKLCPESVSRDMDKVYKYQYDPLINHEKIKAGFASQVLKATNKVRKIISKINTPR   107
WR     LNAPVGKLCPESVSRDMDKVYKYQYDPLINHEKIKAGFASQVLKATNKVRKIISKINTPR   120
Tian   LNAPVGKLCPESVSRDMDKVYKYQYDPLINHEKIKAGFASQVLKATNKVRKIISKINTPR   120
Wyeth  PNAPVGKLCPESVSRDMDKVYKYQYDPLINHEKIKAGFASQVLKATNKVRKIISKINTPP   107
Lister PNAPVGKLCPESVSRDMDKVYKYQYDPLINHEKIKAGFASQVLKATNKVRKIISKINTPP   111
        **********************************************************
```

-continued

```
Cop    LSYSREQTMRL-----VMFQVHIISCNMQIVIE---------------------------     135
WR     LSYSREQTIRL-----AMF-----------------------------------------     134
Tian   LSYSREQTIRL-----AMF-----------------------------------------     134
Wyeth  TLILQGTNNEISDVLGAYYFMQHANCNREIKIYEGAKHHLHKETDEVKKSVMKEIETWIF     167
Lister TLILQGTNNKISDVLGAYYFMQHANCNREIKIYEGAKHHLHKETDEVKKSVMKEIETWIF     171
           :  . .:     . :

Cop    ----
WR     ----
Tian   ----
Wyeth  NRVK                                                             171
Lister NRVK                                                             175
```

K6L

CLUSTAL O(1.2.4) multiple sequence alignment (SEQ ID NOS 578-581, respectively, in order of appearance)

```
Cop    MSANCMFNLDNDYIYWKPITYPKALVFISHGAGKHSGRYDELAENISSLGILVFSHDHIG      60
WR     MSANCMFNIDNDYIYWKPITYPKALVFISHGAGKHSGRYDELAENISSLGILVFSHDHIG      60
Wyeth  MSANCMFNLDNDYIYWKPITYPKALVFISHGAGKHSGRYDELAENISSLGILVFSHDHIG      60
Lister MSANCMFNLDNDYIYWKPITYPKALVFISHGAGKHSGRYDELAENISSLGILVFSHDHIG      60
       ************************************************************

Cop    HGRSNGEKMMIDDFGTARGNY                                             81
WR     HGRSNGEKMMIDDFGTARGNY                                             81
Wyeth  HGRSNGEKMMIDDFGTARGNY                                             81
Lister HGRSNGEKMMIDDFGTARGNY                                             81
       *********************
```

K7R

CLUSTAL O(1.2.4) multiple sequence alignment (SEQ ID NOS 582-586, respectively, in order of appearance)

```
Cop    MATKLDYEDAVFYFVDDDKICSRDSIIDLIDEYITWRNHVIVFNKDITSCGRLYKELMKF      60
WR     MATKLDYEDAVFYFVDDDKICSRDSIIDLIDEYITWRNHVIVFNKDITSCGRLYKELMKF      60
Tian   MATKLDYEDAVFYFVDDDKICSRDSIIDLIDEYITWRNHVIVFNKDITSCGRLYKELMKF      60
Wyeth  MATKLDYEDAVFYFVDDDKICSRDSIIDLIDEYITWRNHVIVFNKDITSCGRLYKELMKF      60
Lister MATKLDYEDAVFYFVDDDKICSRDSIIDLIDEYITWRNHVIVFNKDITSCGRLYKELMKF      60
       ************************************************************

Cop    DDVAIRYYGIDKINEIVEAMSEGDHYINFTKVHDQESLFATIGICAKITEHWGYKKISES     120
WR     DDVAIRYYGIDKINEIVEAMSEGDHYINFTKVHDQESLFATIGICAKITEHWGYKKISES     120
Tian   DDVAIRYYGIDKINEIVEAMSEGDHYINFTKVHDQESLFATIGICAKITEHWGYKKISES     120
Wyeth  DDVAIRYYGIDKINEIVEAMSEGDHYINFTKVHDQESLFATIGICAKITEHWGYKKISES     120
Lister DDVAIRYYGIDKINEIVEAMSEGDHYINFTKVHDQESLFATIGICAKITEHWGYKKISES     120
       ************************************************************

Cop    RFQSLGNITDLMTDDNINILILFLEKKLN                                    149
WR     RFQSLGNITDLMTDDNINILILFLEKKLN                                    149
Tian   RFQSLGNITDLMTDDNINILILFLEKKLN                                    149
Wyeth  RFQSLGNITDLMTDDNINILILFLEKKLN                                    149
Lister RFQSLGNITDLMTDDNINILILFLEKKLN                                    149
       *****************************
```

F1L

CLUSTAL O(1.2.4) multiple sequence alignment (SEQ ID NOS 587-591, respectively, in order of appearance)

```
Cop    MLSMFMCNNIVDYVDDIDNGIVQDIEDEASNNVDHDYVYPLPENMVYRFDKSTNILDYLS      60
WR     MLSMFMCNNIVDYVDDIDNGIVQDIEDEASNNVDHDYVYPLPENMVYRFDKSTNILDYLS      60
Tian   MLSMFMCNNIVDYVDDIDNGIVQDIEDEASNNVDRDYVYPLPENMVYRFDKSTNILDYLS      60
Wyeth  MLSMFMCNNIVDYVDDIDNGIVQDIEDEASNNVDHDYVYPLPENMVYRFDKSTNILDYLS      60
Lister MLSMFMCNNIVDYVDDIDNGIVQDIEDEASNNVDHDYVYPLPENMVYRFDKSTNILDYLS      60
       **********************************:*************************

Cop    TERDHVMMAVRYYMSKQRLDDLYRQLPTKTRSYIDIINIYCDKVSNDYNRDMNIMYDMAS     120
WR     TERDHVMMAVRYYMSKQRLDDLYRQLPTKTRSYIDIINIYCDKVSNDYNRDMNIMYDMAS     120
Tian   TERDHVMMAVRYYMSKQRLDDLYRQLPTKTRSYIDIINIYCDKVSNDYNRDMNIMYDMAS     120
Wyeth  TERDHVMMAVRYYMSKQRLDDLYRQLPTKTRSYIDIINIYCDKVSNDYNRDMNIMYDMAS     120
Lister TERDHVMMAVRYYMSKQRLDDLYRQLPTKTRSYIDIINIYCDKVSNDYNRDMNIMYDMAS     120
       ************************************************************

Cop    TKSFTVYDINNEVNTILMDNKGLGVRLATISFITELGRRCMNPVKTIKMFTLLSHTICDD     180
WR     TKSFTVYDINNEVNTILMDNKGLGVRLATISFITELGRRCMNPVETIKMFTLLSHTICDD     180
Tian   TKSFTVYDINNEVNTILMDNKGLGVRLATISFITELGRRUMNPVKTIKMFTLLSHTICDD     180
Wyeth  TKSFTVYDINNEVNTILMDNKGLGVRLATISFITKLGRRCMNPVKTIKMFTLLSHTICDD     180
Lister TKSFTVYDINNEVNTILMDNKGLGVRLATISFITELGRRCMNPVKTIKMFTLLSHTICDD     180
       **********************************:*********:***************
```

-continued

```
Cop    CFVDYITDISPPDNTIPNTSTREYLKLIGITAIMFATYKTLKYMIG              226
WR     YFVDYITDISPPDNTIPNTSTREYLKLIGITAIMFATYKTLKYMIG              226
Tian   CFVDYITDISPPDNTIPNTSTREYLKLIGITAIMFATYKTLKYMIG              226
Wyeth  CFVDYITDISPPDNTIPNTSTREYLKLIGITAIMFATYKTLKYMIG              226
Lister CFVDYITDISPPDNTIPNTSTREYLKLIGITAIMFATYKTLKYMIG              226
       **********************************************
```

F2L

CLUSTAL O(1.2.4) multiple sequence alignment (SEQ ID NOS 592-596, respectively, in order of appearance)

```
Cop    MFNMNINSPVRFVKETNRAKSPTRQSPGAAGYDLYSAYDYTIPPGERQLIKTDISMSMPK  60
WR     MFNMNINSPVRFVKETNRAKSPTRQSPYAAGYDLYSAYDYTIPPGERQLIKTDISMSMPK  60
Tian   MFNMNINSPVRFVKETNRAKSPTRQSPGAAGYDLYSAYDYTIPPGERQLIKTDISMSMPK  60
Wyeth  MFNMNINSPVRFVKETNRAKSPTRQSPGAAGYDLYSAYDYTIPPGERQLIKTDISMSMPK  60
Lister MFNMNINSPVRFVKETNRAKSPTRQSPGAAGYDLYSAYDYTIPPGERQLIKTDISMSMPK  60
       ************************************************************

Cop    ICYGRIAPRSGLSLKGIDIGGGVIDEDYRGNIGVILINNGKCTFNVNTGDRIAQLIYQRI  120
WR     FCYGRIAPRSGLSLKGIDIGGGVIDEDYRGNIGVILINNGKCTFNVNTGDRIAQLIYQRI  120
Tian   ICYGRIAPRSGLSLKGIDIGGGVIDEDYRGNIGVILINNGKCTFNVNTGDRIAQLIYQRI  120
Wyeth  ICYGRIAPRSGLSLKGIDIGGGVIDEDYRGNIGVILINNGKCTFNVNTGDRIAQLIYQRI  120
Lister FCYGRIAPRSGLSLKGIDIGGGVIDEDYRGNIGVILINNGKCTFNVNTGDRIAQLIYQRI  120
       :***********************************************************

Cop    YYPELEEVQSLDSTNRGDQGFGSTGLR                                   147
WR     YYPELEEVQSLDSTNRGDQGFGSTGLR                                   147
Tian   YYPELEEVQSLDSTDRGDQGFGSTGLR                                   147
Wyeth  YYPELEEVQSLDSTNRGDQGFGSTGLR                                   147
Lister YYPELEEVQSLDSTNRGDQGFGSTGLR                                   147
       **************:************
```

F3L

CLUSTAL O(1.2.4) multiple sequence alignment (SEQ ID NOS 597-601, respectively, in order of appearance)

```
Cop    MPIFVNTVYCKNILALSMTKKFKTIIDAIGGNIIVNSTILKKLSPYFRTHLRQKYTKNKD  60
WR     MPIFTNTVYCKNILALSMTKKFKTIIDAIGGNIIVNSTILKKLSPYFRTHLRQKYTKNKD  60
Tian   MPIFVNTVYCKNILALSMTKKFKTIIDAIGGNIIVNSTILKKLSPYFRTHLRQKYTKNKD  60
Wyeth  MPIFVNTVYCKNILALSMTKKFKTIIDAIGGNIIVNSTILKKLSPYFRTHLRQKYTKNKD  60
Lister MPIFVNTVYCKNILALSMTKKFRTIIDAIGGNSIVNSTILKKLSPYFRTHLRQKYTKNKD  60
       ************************************************************

Cop    PVTRVCLDLDIHSLTSIVIYSYTGKVYIDSHNVVNLLRASILTSVEFIIYTCINFILRDF  120
WR     PVTWVCLDLDIHSLTSIVIYSYTGKVYIDSHNVVNLLRASILTSVEFIIYTCINFILRDF  120
Tian   PVTRVCLDLDIHSLTSIVIYSYTGKVYIDSHNVVNLLRASILTSVEFIIYTCINFILRDF  120
Wyeth  PVTRVCLDLDIHSLTSIVIYSYTGKVYIDSHNVVNLLRASILTSVEFIIYTCINFILRDF  120
Lister PVTRVCLDLDIHSLTSIVIYSYTGKVYIDSHNVVNLLRASILTSVEFIIYTCINFILRDF  120
       *** ********************************************************

Cop    RKEYCVECYMMGIEYGLSNLLCHTKNFIAKHFLELEDDIIDNFDYLSMKLILESDELNVP  180
WR     RKEYCVECYMMGIEYGLSNLLCHTKNFIAKHFLELEDDIIDNFDYLSMKLILESDELNVP  180
Tian   RKEYCVECYMMGIEYGLSNLLCHTKNFIAKHFLELEDDIIDNFDYLSMELILESDELNVP  180
Wyeth  RKEYCVECYMMGIEYGLSNLLCHTKNFIAKHFLELEDDIIDNFDYLSMKLILESDELNVP  180
Lister RKEYCVECYMMGIEYGLSNLLCHTKNFIAKHFLELEDDIIDNFDYLSIKLILESDELNVP  180
       ***********************************************:************

Cop    DEDYVVDFVIKWYIKRRNKLGNLLLLIKNVIRSNYLSPRGINNVKWILDCTKIFHCDKQP  240
WR     DEDYVVDFVIKWYIKRRNKLGNLLLLIKNVIRSNYLSPRGINNVKWILDCTKIFHCDKQP  240
Tian   DEDYVVDFVIKWYIKRRNKLGNLLLLIKNVIRSNYLSPRGINNVKWILDCTKIFHCDKQP  240
Wyeth  DEDYVVDFVIKWYIKRRNKLGNLLLLIKNVIRSNYLSPRGINNVKWILDCTKIFHCDKQP  240
Lister DEDYVVDFVIKWYIKRRNKLGNLLLLIKNVIRSNYLSPRGINNVKWILDCTKIFHCDKQP  240
       ************************************************************

Cop    RKSYKYPFIEYPMNMDQIIDIFHMCTSTHVGEVVYLIGGWMNNEIHNNAIAVNYISNNWI  300
WR     RKSYKYPFIEYPMNMDQIIDIFHMCTSTHVGEVVYLIGGWMNNEIHNNAIAVNYISNNWI  300
Tian   RKSYKYPFIEYPMNMDQIIDIFHMCTSTHVGEVVYLIGGWMNNEIHNNAIAVNYISNNWI  300
Wyeth  RKSYKYPFIEYPMNMDQIIDIFHMCTSTHVGEVVYLIGGWMNNEIHNNAIAVNYISNNWI  300
Lister RKSYKYPFIEYPMNMDQIIDIFHMCTSTHVGEVVYLIGGWMNNEIHNNAIAVNYISNNWI  300
       ************************************************************

Cop    PIPPMNSPRLYATGIPANNKLYVVGGLPNPTSVERWFHGDAAWVNMPSLLKPRCNPAVAS  360
WR     PIPPMNSPRLYASGIPANNKLYVVGGLPNPTSVERWFHGDAAWVNMPSLLKPRCNPAVAS  360
Tian   PIPPMNSPRLYASGIPANNKLYVVGGLPNPTSVERWFHGDAAWVNMPSLLKPRCNPAVAS  360
Wyeth  PIPPMNSPRLYASGIPANNKLYVVGGLPNPTSVERWFHGDAAWVNMPSLLKPRCNPAVAS  360
Lister PIPPMNSPRLYASGIPANNKLYVVGGLPNPTSVERWFHGDAAWVNMPSLLKPRCNPAVAS  360
       ************:***********************************************
```

-continued

```
Cop    INNVIYVMGGHSETDTTTEYLLPNHDQWQFGPSTYYPHYKSCALVFGRRLFLVGRNAEFY      420
WR     INNVIYVMGGHSETDTTTEYLLPNHDQWQFGPSTYYPHYKSCALVFGRRLFLVGRNAEFY      420
Tian   INNVIYVMGGHSETDTTTEYLLPNHDQWQFGPSTYYPHYKSCALVFGRRLFLVGRNAEFY      420
Wyeth  INNVIYVMGGHSETDTTTEYLLPNHDQWQFGPSTYYPHYKSCALVFGRRLFLVGRNAEFY      420
Lister INNVIYVMGGHSETDTTTEYLLPNHDQWQFGPSTYYPHYKSCALVFGRRLFLVGRNAEFY      420
       ************************************************************

Cop    CESSNTWTLIDDPIYPRDNPELIIVDNKLLLIGGFYRGSYIDTIEVYNHHTYSWNIWDGK      480
WR     CESSNTWTLIDDPIYPRDNPELIIVDNKLLLIGGFYRESYIDTIEVYNHHTYSWNINDGK      480
Tian   CESSNTWTLIDDPIYPRDNPELIIVDNKLLLIGGFYRESYIDTIEVYNHHTYSWNINDGK      480
Wyeth  CESSNTWTLIDDPIYPRDNPELIIVDNKLLLIGGFYRESYIDTIEVYNHHTYSWNIWDGK      480
Lister CESSNTWTLIDDPIYPRDNPELIIVDNKLLLIGGFYRESYIDTIEVYNHHTYSWNIWDGK      480
       ************************************* **********************
```

B14R

CLUSTAL O(1.2.4) multiple sequence alignment (SEQ ID NOS 602-605, respectively, in order of appearance)

```
Cop    ------------------------------------------------------------
WR     MDIFREIASSMKGENVFISPASISSVLTILYYGANGSTAEQLSKYVEKEENMDKVSAQNI       60
Tian   ------------------------------------------------------------
Wyeth  ------------------------------------------------------------

Cop    ------------------------------------------------------------
WR     SFKSINKVYGRYSAVFKDSFLRKIGDKFQTVDFTDCRTIDAINKCVDIFTEGKINPLLDE      120
Tian   ------------------------------------------------------------
Wyeth  ------------------------------------------------------------

Cop    ---MNHCLLAISAVYFKAKWLTPFEKEFTSDYPFYVSPTEMVDVSMMSMYGELFNHASVK       57
WR     PLSPDTCLLAISAVYFKAKNLTPFEKEFTSDYPFYVSPTEMVDVSMNSMYGKAFNHASVK      180
Tian   ---MNHCLLAISAVYFKAKWLTPFEKEFTSDYPFYVSPTEMVDVSMMSMYGKAFNHASVK       57
Wyeth  ---MNHCLLAISAVYFKAKWLTPFEKEFTSDYPFYVSPTEMVDVSMMSMYGKAFNHASVK       57
           : *********************************************: *******

Cop    ESFGNFSIIELPYVGDTSMMVILPDKIDGLESIEQNLTDTNFKKWCNSLDAMFIDVHIPK      117
WR     ESFGNFSIIELPYVGDTSMMVILPDKIDGLESIEQNLTDTNFKKWCNSLEATFIDVHIPK      240
Tian   ESFGNFSIIELPYVGDTSMMVILPDKIDGLESIEQNLTDTNFKKWCDFMDAMFIDVHIPK      117
Wyeth  ESFGNFSIIELPYVGDTSMMVILPDKIDGLESIEQNLTDTNFKKWCDFMDAMFIDVHIPK      117
       **********************************************: ::* ********

Cop    FKVTGSYNLVDTLVKSGLTEVFGSTGDYSNMCNLDVSVDAMIHKTYIDVNEEYTEAAAAT      177
WR     FKVTGSYNLVDTLVKSGLTEVFGSTGDYSNMCNSDVSVDAMIHKTYIDVNEEYTEAAAAT      300
Tian   FKVTGSYNLVDTLVKSGLTEVFGSTGDYSNMCNLDVSVDAMIHKTYIDVNEEYTEAAAAT      177
Wyeth  FKVTGSYNLVDTLVKSGLTEVFGSTGDYSNMCNLDVSVDAMIHKTYIDVNEEYTFAAAAT      177
       ********************************* **************************

Cop    CALVSDCASTITNEFCVDHPFIYVIRHVDGKILFVGRYCSPTTNC                     222
WR     CALVSDCASTITNEFCVDHPFIYVIRHVDGKILFVGRYCSPTTNC                     345
Tian   CALVSDCASTITNEFCVDHPFIYVIRHVDGKILFVGRYCSPTTNC                     222
Wyeth  CALVSDCASTVTNEFCADHPFIYVIRHVDGKILFVGRYCSPTTNC                     222
       **********:*****.****************************
```

B15R

CLUSTAL O(1.2.4) multiple sequence alignment (SEQ ID NOS 606-610, respectively, in order of appearance)

```
Cop    MTANFSTHVFSPQHCGCDRLTSIDDVKQCLTEYIYWSSYAYRNRQCAGQLYSTLLSFRDD       60
WR     MTANFSTHVFSPQHCGCDRLTSIDDVKQCLTEYIYWSSYAYANRQCAGQLYSTLLSFRDD       60
Tian   MTANFSTHVFSPQHCGCDRLTSIDDVKQCLTEYIYWSSYAYRNRQCAGQLYSTLLSFRDD       60
Wyeth  MTANFSTHVFSPQHCGCDRLTSIDDVKQCLTEYIYWSSYAYRNRQCAGQLYSTLLSFRDD       60
Lister MTANFSTHVFSPQHCGCDRLTSIDDVKQCLTEYIYWSSYAYRNRQCAGQLYSTLLSFRDD       60
       **************************:*********************************

Cop    AELVFIDIRELVKNMPWDDVKDCTEIIRCYIPDEQKTIREISAIIGLCAYAATYWGGEDH      120
WR     AELVFIDIRELVKNMPWDDVKDCAEIIRCYIPDEQKTIREISAIIGLCAYAATYWGGEDH      120
Tian   AELVFIDIRELVKNMEWDDVKDCTEIIRCYIPDEQKTIREISAIIGLCAYAATYWGGEDH      120
Wyeth  AELVFIDIRELVKHMPWDDVKDCAEIIRCYIPDEQKTIREISAIIGLCAYAATYWGGEDH      120
Lister AELVFIDIRELVKNMPWDDVKDCTEIIRCYIPDEQKTIREISAIIGLCAYAATYWGGEDH      120
       *************:*********:************************************

Cop    PTSNSLNALFVMLEMLNYVDYNIIFRRMN                                     149
WR     PTSNSLNALFVMLEMLNYVDYNIIFRRMN                                     149
Tian   PTSNSLNALFVMLEMLNYVDYNIIFRRMN                                     149
Wyeth  PTSNSLNALFVMLEMLNYVDYNIIFRRMN                                     149
Lister PTSNSLNALFVMLEMLNYVDYNIIFRRMN                                     149
       *****************************
```

-continued

B ORF E

CLUSTAL O(1.2.4) multiple sequence alignment (SEQ ID NOS 611-612, respectively, in order of appearance)

```
Cop    MYNSSIHTPEYDVIIHVIEHLKHHKQCVQTVTSGMVFTSPVSSSICTKSDDGRNLSDGFL      60
Tian   MYNSSIHTPEYDVIIHVIEHLKHHKQCVQTVTSGMVFTSPVSSSICTKSDDGRNLSDGFL      60
       ************************************************************

Cop    LIRYITTDDFCTIFDIIPRHIFYQLANVDEH                                   91
Tian   LIRYITTDDFCTIFDIIPRHIFYQLANVDEH                                   91
       *******************************
```

B16R

CLUSTAL O(1.2.4) multiple sequence alignment (SEQ ID NOS 613-617, respectively, in order of appearance)

```
Cop    MSILPVIFLPIFFYSSFVQTFNASECIDKGXYFASFMELENEPVILPCPQINTISSGYNI      60
WR     MSILPVIFLSIFFYSSFVQTFNAPECIDKGQYFASFMELENEPVILPCPQINTLSSGYNI      60
Tian   ------------------------------------MELENEPVILPCPQINTLSSGYNI      24
Wyeth  MSILPVIFLSIFFYSSFVQTFNASECIDKGQYFASFMELENEPVILPCPQINTLSSGYNI      60
Lister MSILPVIFLPIFFYSSFVQTFNAPECIDKGQYFASFMELENEPVILPCPQINTLSSGYNI      60
                                           ************************

Cop    LDILWEKRGADNDRIIPIDNGSNMLILNPTQSDSGIYICITTNETYCDMMSLNLTIVSVS     120
WR     LDILWEKRGADNDRIIPIDNGSNMLILNPTQSDSGIYICITTNETYCDMMSLNLTIVSVS     120
Tian   LDILWEKAGADNDRIIPIDNGSNMLILNPTQSDSGIYICITTNETYCDMMSLNLTIVSVL      84
Wyeth  LDILWEKRGADNDRIIPIDNGSNMLILNPTQSDSGIYICITTNETYCDMMSLNLTIVSVS     120
Lister LDILWEKRGADNDRIIPIDNGSNMLILNPTQSDSGIYICITTNETYCDMMSLNLTIVSVS     120
       ************************************************************

Cop    ESNIDFISYPQIVNERSTGEMVCPNINAFIASNVNADIIWSGHRRLRNKRLKQRTPGIIT     180
WR     ESNIDLISYPQIVNERSTGEMVCPNINAFIASNVNADIIWSGHRRLRNKRLKQRTPGIIT     180
Tian   ESNIDLISYPQIVNERSTGEMVCPNINAFIASNVNADIIWSGHRRLRNKRLKQRTPGIIT     144
Wyeth  ESNIDLISYPQIVNERSTGEMVCPNINAFIASNVNADIIWSGHRRLRNKRLKQRTPGIIT     180
Lister ESNIDLISYPQIVNERSTGEMVCPNINAFIASNVNADIIWSGHRRLRNKRLKQRTPGIIT     180
       *****:******************************************************

Cop    IEDVRKNDAGYYTCVLEYIYGGKTYNVTRIVKLEVRDKIIHPTMQLPEGVVTSIGSNLTI     240
WR     IEDVRKNDAGYYTCVLEYIYGGKTYNVTRIVKLEVRDKIIPSTMQLPDGIVTSIGSNLTI     240
Tian   IEDVRKNDAGYYTCVLEYIYRGKTYNVTRIVKLEVRDKIIPSTMQLPDGIVTSIGSNLTI     204
Wyeth  IEDVRKNDAGYYTCVLEYIYGGKTYNVTRIVKLEVRDKIIPSTMQLPDGIVTSIGSNLTI     240
Lister IEDVRKNDAGYYTCVLEYIYRGKTYNVTRIVKLEVRDKIIPSTMQLPDGIVTSIGSNLTI     240
       ******************** *******************  *****:*:**********

Cop    ACRVSLRPPTTDADVFWISNGMYYEEDDGDGDGRISVANKIYMTDKRRVITSRLNINPVK     300
WR     ACRVSLRPPTTDADVFWISNGMYYEEDDGDGNGRISVANKIYMTDKRRVITSRLNINPVK     300
Tian   ACRVSLRPPTTDADVFWISNGMYYEEDDGDGNGRISVANKIYMTDKRRVITSRLNINPVK     264
Wyeth  ACRVSLRPPTTDTDVFWISNGMYYEEDDGDGDGRISVANKIYMIDKRRVITSRLNINPVK     300
Lister ACRVSLRPPTTDADVFWISNGMYYEEDDGDGNGRISVANKIYMTDKRRVITSRLNINPVK     300
       ************:******************:****************************

Cop    EEDATTFTCMAFTIPSISKTVTVSIT                                       326
WR     EEDATTFTCMAFTIPSISKTVTVSIT                                       326
Tian   EEDATTFTCMAFTIPSISKTVTVSI-                                       289
Wyeth  EEDATTFTCMAFTIPSISKTVTVSIT                                       326
Lister EEDATTFTCMAFTIPSISKTVTVSIT                                       326
       *************************
```

B ORF F

CLUSTAL O(1.2.4) multiple sequence alignment (SEQ ID NOS 618-619, respectively, in order of appearance)

```
Cop    MVIIPGVRCLSLLFLRRRCPLHIISAFTLLAINALILGHTISPVDLSFTICGYEIKSIFD      60
Tian   MVIIPGVRCLSLLFLAARCPLHIISAFTLLAINALILGHTISPVDLSFTICGYEIRSIFD      60
       *******************************************************:****

Cop    SETDTIVKFNDIMSQ                                                   75
Tian   SKTDTIVKFNDIMSQ                                                   75
       *:*************
```

-continued

B17L

CLUSTAL O(1.2.4) multiple sequence alignment (SEQ ID NOS 620-624, respectively, in order of appearance)

```
Cop    MSRKFMQVYEYDREQYLDEFIEDRYNDSFITSPEYYSAEKYMCRYTTLNHNCVNVRRCAL   60
WR     MSRKFMQVYEYDREQYLDEFIEDRYNDSFITSPEYYSAEKYMCRYTTLNHNCINVRRCAL   60
Tian   MSRKFMQVYEYDREQYLDEFIEDRYNDSFITSPEYYSAEKYMCRYTTLNHNCVNVRRCAL   60
Wyeth  MSRKFMQVYEYDREQYLDEFIEDRYNDSFITSPEYYSAEKYMCRYTTLNHNCVNVRRCAL   60
Lister MSRKFMQVYEYDREQYLDEFIEDRYNDSFITSPEYYSAEKYMCRYTTLNHNCINVRRCAL   60
       ****************************************************:*******

Cop    DSKLLHDIITNCKIYNNIELVRATKFVYYLDLIKCNWVSKVGDSVLYPVIFITHTSTRNL  120
WR     DSKLLHDIITNCKIYNNIELVRATKFVYYLDLIKCNWVSKVGDSVLYPVIFITHTSTRNL  120
Tian   DSKLLHDIITNCKIYNNIELVRATKFVYYLDLIKCNWVSKVGDSVLYPVIFITHTSTRNL  120
Wyeth  DSKLLHDIITNCKIYNNIELVRATKFVYYLDLIKCNWVSKVGDSVLYPVIFITHTSTRNL  120
Lister DSKLLHDIITNCKIYNNIELVRATKFVYYLDLIKCNWVSKVGDSVLYPVIFITHTSTRNL  120
       ************************************************************

Cop    DKVSVKTYKGVKVKKLNRCADHAIVINPFVKFKLTLPNKTSHAKVLVTFCKLRTDITPVE  180
WR     DKVSVKTYKGVKVKKLNRCADHAIVINPFVKFKLTLPNKTSHAKVLVTFCKLKTDITPVE  180
Tian   DKVSVKTYKGVKVKKLNRCADHAIVINPFVKFKLTLPNKTSHAKVLVTFCKLRTDITQIE  180
Wyeth  DKVSVKTYKGVKVKKLNRCADHAIVINPFVKFKLTLPNKTSHAKVLVTFCKLRTDITQIE  180
Lister DKVSVKTYKGVKVKKLNRCADHAIVINPFVKFKLTLPNKTSHAKVLVTFCKLRTDITQIE  180
       ****************************************************:**** :*

Cop    APLPGNVLVYTFPDINKRIPGYIHVNIEGCIDGMIYINSSKFACVLKLHRSMYRIPPFPI  240
WR     APLPGNVLVYTFPDINKRIPGYIHVNIEGCIDGMIYINSSKFACVLKLHRSMYRIPPFPI  240
Tian   APLSGNVLVYTFPNINKRIPGYIHVNIEGCIDGMIYINSSKFACVLKLHRSMYRIPPFPI  240
Wyeth  AFISGNVLVYTFPDINKRIPGYIHVNIEGCIDGMIYINSSKFACVLKLHRSMYRIPPFPI  240
Lister APLSGNVLVYTFPDINKRIPGYIHVNIEGCIDGMIYINSSKFACVLKLHRSMYRIPPFPI  240
       *** *********:**********:***********************************

Cop    DICSCCSQYTNDDIEIPIHDLIKDVAIFKNKETVYYLKLNNKTIARFTYFNNIDTAITQE  300
WR     DICSCCSQYINYDIEIPIHDLIKDVAIFKNKETVYYLKLNNKTIARFTYFNNIDTAITQE  300
Tian   DICSCCSQYTNGDIEIPIHDLIKDVAIFKNKETVYYLKLNNKTIARFTYFNNIDTAITQE  300
Wyeth  DICSCCSQYTNDDIEIPIHDLIKDVAIFKNKETVYYLKLNNKTIARFTYFNNIDTAITQE  300
Lister DICSCCSQYTNDDIEIPIHDLIKDVAIFKNKETVYYLKLNNKTIARFTYFNNIDTAITQE  300
       ********* * ***********************************************

Cop    HEYVKIALGIVCKLMINNMHSIVGVNHSNTFVNCLLEDNV                      340
WR     HEYVKIALGIVCKLMINNMHSIVGVNHSNTFVNCLLEDNV                      340
Tian   HEYVKIALGIVCKLMINNMHSIVGVNRSNTFVNCLLEDNV                      340
Wyeth  HEYVKIALGIVCKLMINNMHSIVGVNHSNTFVNCLLEDNV                      340
Lister HEYVKIALGIVCKLMINNMHSIVGVNHSNTFVNCLLEDNV                      340
       ****************************************
```

B18R

CLUSTAL O(1.2.4) multiple sequence alignment (SEQ ID NOS 625-628, respectively, in order of appearance)

```
Cop    MSRRLIYVLNINRKSTHKIQENEIYTYFSHCNIDHTSTELDFVVKNYDLNRRQHVTGYTA   60
WR     MSRRLIYVLNINRESTHKIQENEIYTYFSHCNIDHTSTELDFVVKNYDLNRRQPVTGYTA   60
Tian   MSRRLIYVLNINRESTHKIQENEIYTYFSHCNIDHTSTELDFVVKNYDLNRRHPVTGYTA   60
Wyeth  MSRRLIYVLNINRESTHKIQENEIYTYFSHCNIDHTSTELDFVVKNYDLNRRQPVTGYTA   60
       *************:**************************************: ******

Cop    LHCYLYNNYFTNDVLKILLNHDVNVTMKTSSGRMPVYILLTRCCNISHDVVIDMIDKDKN  120
WR     LHCYLYNNYFTNDVLKILLNHGVDVTMKTSSGRMPVYILLTRCCNISHDVVIDMIDKDKN  120
Tian   LHCYLYNNYFTNDVLKILLNHGVDVTMKTSSGRMPVYILLTRCCNISHDVVIDMIDKDKN  120
Wyeth  LHCYLYNNYFTNDVLKILLNHGVDVTMKTSSGRMPVYILLTRCCNISHDVVIDMIDKDKN  120
       *********************.*:************************************

Cop    HLSHRDYSNLLLEYIKSRYMLLKEEDIDENIVSTLLDKGIDPNETQDGYTALHYYYLCLA  180
WR     HLLHRDYSNLLLEYIKSRYMLLKEEDIDENIVSTLLDKGIDPNFKQDGYTALHYYYLCLA  180
Tian   HLLHRDYSNLLLEYIKSRYMLLKEEDIDENIVSTLLDKGIDPNFKQDGYTALHYYYLCLA  180
Wyeth  HLSHRDYSNLLLEYIKSRYMLLKEEDIDENIVSTLLDKGIDPNFKQDGYTALHYYYLCLA  180
       ** *********************************************************

Cop    HVYKPGECRKPITIKKAKRIISLFIQHGANLNALDNCGNTPFHLYLSIEMCNNIHMTKML  240
WR     HVYKPGECRKPITIKKAKRIISLFIQHGANLNALDNCGNTPFHLYLSIEMCNNIHMTKML  240
Tian   HVYKPGECRKPITIKKAKRIISLFIQHGANLNALDNCGNTPFHLYLSIEMCNNIHMTKML  240
Wyeth  HVYKPGECRKPITIKKAKRIISLFIQHGANLNALDNCGNTPFHLYLSIEMCNNIHMTKML  240
       ************************************************************
```

-continued

```
Cop    LTFNPNFKICNNHGLTPILCYITSDYIQHDILVMLIHHYETNVGEMPIDERRMIVFEFIK    300
WR     LTFNPNFEICNNHGLTPILCYITSDYIQHDILVMLIHHYETNVGEMPIDERRIIVFEFIK    300
Tian   LTFNPNFKICNNHGLTPILCYITSDYIQHDILVMLIHHYETNVGEMPIDERRIIVFEFIK    300
Wyeth  LTFNPNFKICNNHGLTPILCYITSDYIQHDILVMLIHHYETNVGEMPIDERRIIVFEFIK    300
       *******:********************************************:*******

Cop    TYSTRPADSITYLMNRFKNINIYTRYEGKTLLHVACEYNNTQVIDYLIRINGDINALTDN    360
WR     TYSTRPADSITYLMNRFKNIDIYTRYEGKTLLHVACEYNNTHVIDYLIRINGDINALTDN    360
Tian   TYSTRPADSITYLMNRFKNINIYTRYEGKTLLHVACEYNNTQVIDYLIRINGDINALTDN    360
Wyeth  TYSTRPADSITYLMNRFKNINIYTRYEGKTLLHVACEYNNTHVIDYLIRINGDINALTDN    360
       ********************:********************:******************

Cop    NKHATQLIIDNKENSPYTINCLLYILRYIVDKNVIRSLVDQLPSLPIFDIKSFEKFISYC    420
WR     NKHATQLIIDNKENSPYTINCLLYILRYIVDKNVIRSLVDQLPSLPIFDIKSFEKFISYC    420
Tian   NKHATQLIIDNKENSPYTINCLLYILRYIVDKNVIRSLVDOLPSLPIFDIKSFEKFISYC    420
Wyeth  NKHAIQLIIDNKENSPYTIDCLLYILRYIVDKNVIRSLVDQLPSLPIFDIKSFEKFISYC    420
       **** **************:****************************************

Cop    ILLDDTFYDRHVKNRDSKTYRYAFSKYMSFDKYDGIITKCHDETMLLKLSTVLDTTLYAV    480
WR     ILIDDTFYNRHVRNRDSKTYRYAFSKYMSFDKYDGIITKCHKETILLKLSTVLDTTLYAV    480
Tian   ILLDDTFYDRHVKNRNSKTYRYAFSKYMSFDKYDGIITKCHDETMLLKLSTVLDTTLYAV    480
Wyeth  ILLDDTFYNRHVRNRNSKTYRYAFSKYMSFDKYDGIITKCHDETMLLKLSTVLDTTLYAV    480
       ********:***:**:*************************.**:***************

Cop    LRCHNSRKLRRYLTELKKYNNDKSFKIYSNIMNERYLNVYYKDMYVSKVYDKLFPVFTDK    540
WR     LRCHNSKKLRRYLTELKKYNNDKSFKIYSNIMNERYLNVYYKDMYVSKVYDKLFPVFTDK    540
Tian   LRCHNSRKLRRYLTELKKYNNDKSFKIYSNIMNERYLNVYYKDMYVSKVYDKLFPVFTDK    540
Wyeth  LRCHNSKKLRRYLNELKKYNNDKSFKIYSNIMNERYLNVYYKDMYVSKVYDKLFPVFTDK    540
       ******:******.**********************************************

Cop    NCLLTLLPSEIIYEILYMLTINDLYNISYPPTKV                              574
WR     NCLLTILPSEIIYEILYMLTINDLYNISYPPTKV                              574
Tian   NCLLTLLPSEIIYEILYMLTINDLYNISYPPTKV                              574
Wyeth  NCLLTLLPSEIIYEILYMLTINDLYNISYPPTKV                              574
       ----------------------------------
```

B19R

CLUSTAL O(1.2.4) multiple sequence alignment (SEQ ID NOS 629-632, respectively, in order of appearance)

```
Cop    MTMKMMVHIYFVSLSLLLLLFHSYAIDIENEITEFFNKMRDTLPAKDSKWLNPACMFGGT     60
WR     MTMKMMVHIYFVSL--LLLLFHSYAIDIENEITEFFNKMRDTIPAKDSKWLNPACMFGGT     58
Tian   MTMKMMVHIYFVSLSLLLLLFHSYAIDIENEITEFFNKMRDTLPAKDSKWLNPACMFGGT     60
Wyeth  MTMKMMVHIYFVSLSLLLLLFHSYAIDIENEITEFFNKMRDTLPAKDSKWLNPACMFGGT     60
       **************  ********************************************

Cop    MNDMATLGEPFSAKCPPIEDSLLSHRYKDYVVKWERLEKNRRRQVSNKRVKHGDLWIANY    120
WR     MNDIAALGEPFSAKCPPIEDSLLSHRYKDYVVKWERLEKNRRRQVSNKRVKHGDLWIANY    118
Tian   MNDIAALGEPFSAKCPPIEDSLLSHRYKDYVVKWERLEKNRRRQVSNKRVKHGDLWIANY    120
Wyeth  MNDIATLGEPFSAKCPPIEDSLLSHRYKDYVVKWERLEKNRRRQVSNKRVKHGDLWIANY    120
       ***:*:******************************************************

Cop    TSKFSNRRYLCTVTTKNGDCVQGIVRSHIKKPPSCIPKTYELGTHDKYGIDLYCGILYAK    180
WR     TSKFSNRRYLCTVTTKNGDCVQGIVRSHIRKPPSCIPKTYELGTHDKYGIDLYCGILYAK    178
Tian   TSKFSNRRYLCTVTTKNGDCVQGIVRSHIKKPPSCIPKTYELGTHDKYGIDLYCGILYAK    180
Wyeth  TSKFSNRRYLCTVTTKNGDCVQGIVRSHIRKPPSCIPKTYELGTHDKYGIDLYCGILYAK    180
       *****************************:******************************

Cop    HYNNITWYKDNKEINIDDIKYSQTGKELIIHNPELEDSGRYDCYVHYDDVRIKNDIVVSR    240
WR     HYNNITWYKDNKEINIDDIKYSQTGKELIIHNPELEDSGRYDCYVHYDDVRIKNDIVVSR    238
Tian   HYNNITWYKDNKEINIDDIKYSQTGKELIIHNPELEDSGRYDCYVHYDDVRIKNDIVVSR    240
Wyeth  HYNNITWYKDNKEINIDDIKYSQTGKKLIIHNPELEDSGRYDCYVHYDDVRIKNDIVVSR    240
       **************************:*********************************

Cop    CKILTVIPSQDHRFKLILDPKINVTIGEPANITCTAVSTSLLIDDVLIEWENPSGWLIGF    300
WR     CKILTVIPSQDHRFKLILDPKINVTIGEPANITCTAVSTSLLIDDVLIEWENPSGWLIGF    298
Tian   CKILTVIPSQDHRFKLILDPKINVTIGEPANITCTAVSTSLLIDDVLIEWENPSGWLIGF    300
Wyeth  CKILVTIPSQDHRFKLKRNCGYASN-----------------------------------    265
       ****************   :     .

Cop    DFDVYSVLTSRGGITEATLYFENVTEEYIGNTYKCRGHNYYFEKTLTTTVVLE           353
WR     DFDVYSVLTSRGGITEATLYFENVTEEYIGNTYKCRGHNYYFEKTLTTTVVLE           351
Tian   DFDVYSVLTSRGGITEATLYFENVTEEYIGNTYKCRGHNYYFEKTLTTTVVLE           353
Wyeth  -----------------------------------------------------
```

B21R
CLUSTAL O(1.2.4) multiple sequence alignment (SEQ ID NOS 633-634, respectively, in order of appearance)

```
Cop    MSLESFIITTFNNNSSTNIDNMCHLYVKVCPSSLLFRLFVECCDINKLVEGTTPLHCYLM    60
Wyeth  MSLESFIITTFNNNSSTNIDNMCHLYVKVCPSSLLFRLFVECCDINKLVEGTTPLHCYLM    60
       ************************************************************

Cop    NEGFESSVLKNLLKEYVMNTFNVHDIHYTNI                                91
Wyeth  NEGFESSVLKNLLKEYVMTSITQIFNS----                                87
       ******************.::.
```

B22R
CLUSTAL O(1.2.4) multiple sequence alignment (SEQ ID NOS 635-637, respectively, in order of appearance)

```
Cop    MISLSFLIHNPLKKWKLKPSISINGYRSTFTMAFPCAQFRPCHCHATKDSLNTVADVRHC    60
Wyeth  MISLSFLIHNPLKKWKLKPSISINGYRSTFTMAFPCAQFRPCHCHATKDSLNTVADVRHC    60
Lister -----------------------------MASPCAKFRPCHCHATKDSLNTVADVRHC    29
                                    ** ***:*********************

Cop    LTEYILWVSHRWTHRESAGSLYRLLISFRTDATELFGGELKDSLPWDNIDNCVEIIKCFI   120
Wyeth  LTEYILWVSHRWTHRETAGPLYRLLISFRTDATELEGGELKDSLPWDNIDNCVEIIKCFI   120
Lister LTEYILWVSHRWTHRESAGSLYRLLISFRTDATELFGGELKDSLPWD---NCVEIIKCFI    86
       ****************:** ************************** *********

Cop    RNDSMKTAEELRAIIGLCTQSAIVSGRVFNDKYIDILLMLRKILNENDYLTLLDHIRTAK   180
Wyeth  RNDSMKTAEELRAIIGLCTQSAIVSGRVFNDKYIDILLMLRKILNENDYLTLLDHIRTAK   180
Lister RNDSMKTAEELRAIIGLCTQSAIVSGRVFNDKYIDILLMLRKILNENDYLTLLDHIRTAK   146
       ************************************************************

Cop    Y                                                              181
Wyeth  Y                                                              181
Lister Y                                                              147
       *
```

B23R
CLUSTAL O(1.2.4) multiple sequence alignment (SEQ ID NOS 638-639, respectively, in order of appearance)

```
Cop    MIAFIIFREIGIISTRIAMDYCGRECTILCRLLDEDVTYKKIKLEIETCHNLSKHIDRRG    60
Wyeth  MIAFIIFREIGIISTRIAMDCT----CILCRLLDEDVTYKKIKLEIETCHNLSKHIDRRG    56
       ********************        *********************************

Cop    NNALHCYVSNKCDTDIKIVRLLLSRGVERLCRNNEGLTPLGAYSKHRYVKSQIVHLLISS   120
Wyeth  NNALHCYVFNKCDTDIKIVRLLLSRGVERLCRNNEGLTPLGVYSKHRYVKSQIVHLLISS   116
       ******** ******************************.*******************

Cop    YSNSSNELKSNINDFDLSSDNIDLRLLKYLIVDKRIRPSKNTNYAINGLGLVDIYVTTPN   180
Wyeth  YSNSSNELKSNINDFDLSSDNIDLRLLKYLIVDKRIRPSKRTNYAINSLGLVDIYVTTPN   176
       ***************************************.******:************

Cop    PRPEVLLWLLKSECYSTGYVFRTCMYNSDMCKNSLHYYISSHRESQSLSKDVIKCLINNN   240
Wyeth  PRPEVLLWLLKSECYSTGYVFRTCMYNSDMCKNSLHYYISSHRESQSLSKDVIKCLINNN   236
       ************************************************************

Cop    VSIHGRDEGGSLPIQYYWSFSTIDIEIVKLLLIKDVDTCRVYDVSPILEAYYLNKRFRVT   300
Wyeth  VSIHGRDEGGSLPIQYYWSFSTIDIEIVKLLLIKDVDTCRVYDVSPILEAYYLNKRFRVT   296
       ************************************************************

Cop    PYNVDMEIVNLLIERRHTLVDVMRSITSYDSREYNHYIIDNILKRFRQQDESIVQAMLIN   360
Wyeth  PYNVDMEIVNLLIERRHTLVDVMRSITSYDSREYNHYIIDNILKRFRQQDESIVQAMLIN   356
       ************************************************************

Cop    YLHYGDMVVRCMLDNGQQLSSARLLC                                     386
Wyeth  YLHYGDMVVRCMLDNGQQLSSARLLC                                     382
       **************************
```

B24R
CLUSTAL O(1.2.4) multiple sequence alignment (SEQ ID NOS 640-641, espectively, in order of appearance)

```
Cop    MYGLILSRFNNCGYHCYETILIDVFDILSKYMDDIDMIDNENKTLLYYAVDVNNIQFAKR    60
Wyeth  MYGLILSRFNNCGYHCYETILIDVFDILSKYMDNIDMIDNENKTLLYYAVDVNNIQFAKR    60
       ********************************:***************************
```

```
Cop     LLEYGASVTTSRSIINTAIQKSSYQRENKTRIVDLLLSYHPTLETMIDAFNRDIRYLYPE      120
Wyeth   LLEYGASVTTSRSIINTAIQKSSYRRENKTKLVDLLLSYHPTLETMIDAFNRDIRYLYPE      120
        ***********************:****.:******************************

Cop     PLFACIRYALILDDDFPSKVSMISPVIIRN-------------------------------     150
Wyeth   PLFACIRYALILDDDFPSKVKYDISGRHKELKRYRVDINRMKNAYISGVSMFDILFKRSK      180
        ********************.           ::

Cop     ------------------
Wyeth   RHRLRYAKNPTSNGTKKN                                                198
```

B25R
CLUSTAL O(1.2.4) multiple sequence alignment (SEQ ID NOS 642-644, respectively, in order of appearance)

```
Cop     MBRINITKKIYCSVFLFLFLFLSYISNYEKVNDEMYEMGEMDEIVSIVRDSMWYIPNVFM      60
WR      ----------------------------------------MDEIVRIVRDSMWYIPNVFM      20
Wyeth   MBRINITKKIYCSVFLF--LFLSYISNYEKVNDEMYEMGEMDEIVSIVRDSMWYIPNVFM      58
                                                ***** **************

Cop     DDGKNEGHVSVNNVCHMYFTFFDVDTSSHLFKLVIKHCDLNKRGNSPLHCYTMNTRFNPS     120
WR      DDGKNEGHVSVNNVCHMYFTFFDVDTSSHLFKLVIKHCDLNKRGNSPLHCYTMNTRFNPS      80
Wyeth   DDGKNEGHVSVNNVCMMYFTFFDVDTSSHLFKLVIKHCDLNKRGNSPLHCYTMNTRFNPS     118
        ***************:********************************************

Cop     VLKILLHHGMRNFDSKDEKGHHYLIHSLSIDNKIFDILTDTIDDFSKSSDLLLCYLRYKF     180
WR      VLKILLHHGMRNFDSKDEKGHHYQSITRSLIY-----------------------------    112
Wyeth   VLKILLHHGMRNFDSKD---DHYQSITRSLIY-----------------------------    147
        *****************   .**   : *:

Cop     NGSLNYYVLYKGSDPNCADEDELTSLHYYCKHISTFYKSNYYKLSHTKMRAEKRFIYAII     240
WR      ------------------------------------------------------------
Wyeth   ------------------------------------------------------------

Cop     DYGANINAVTHLPSTVYQT                                               259
WR      -------------------
Wyeth   -------------------
```

B26R
CLUSTAL O(1.2.4) multiple sequence alignment (SEQ ID NOS 645-648, respectively, in order of appearance)

```
Cop     MEQTLTRLHTYLQQYTKHSPRVVYALLSRGYVIILIVHPSWNDCATGHILIMLLNWHEQK      60
WR      ------------------MLFYLEEPIRGYVIILIVHPSWNDCATGHILIMLLNWHEQK      41
Wyeth   MEQTLTRLHTYLQQYTKHSPRVVYALLSRGYVIILIVHPSWNDCATGHILIMLLNWHEQK      60
Lister  MEQTLTRLHTYLQQYTKHSPRVVYALLSRGYVIILIVHPSWNDCATGHILIMLLNWHEQK      60
                          .               ******************************

Cop     EEGQHLLYLFIKHNQGYTLNILRYLLDRFDIQKDEYIYRLSKL-----------------    103
WR      EEGQHLLYLFIKHNQGYTLNILRYLLDRFDIQKDEYYNTAFQNCNNNVASYIGYDINLPT    101
Wyeth   EEGQHLLYLFIKHNQGYTLNILRYLLDRFDIQKDEYYNTAFQNCNNNVASYIGYDINLPT    120
Lister  EEGQHLLYLFIKHNQGYTLNILRYLLDRFDIQKDEYYNTAFQNCNNNVASYIGYDINLPT    120
        ***********************************:                :

Cop     --------
WR      KDGIRLGV                                                          109
Wyeth   KDGIRLGV                                                          128
Lister  KDGIRLGV                                                          128
```

B27R
CLUSTAL O(1.2.4) multiple sequence alignment (SEQ ID NOS 649-652, respectively, in order of appearance)

```
Cop     MLPHTSDTTSTFRLKTVFDLVFENRNIIYKADVVNDIIKHRLKVSLPMIKSLFYKMSEFS      60
WR      MLPHTSDTTSTFRLKTVFDLVFENRNIIYKADVVNDIIHHRLKVSLPMIKSLFYKMSEFS      60
Wyeth   MLPHTSDTTSTFRLKTVFDLVFENRNIIYKADVVNDIIHHRLK--VPMIKSLFYKMSEFS      58
Lister  MLPHTSDTTSTFRLKTVFDLVFENRNIIYKADVVNDIIHHRLKVSLPMIKSLFYKMSLPT      60
        **************************************:****  :**********   :

Cop     PYDDYYVKKILAYCLLRDESFAELHSKFCLNEDYKSVFMKNISFDKIDSIIVT             113
WR      TITT--------------------------------------------------             64
Wyeth   PYDDYYVKKILAYCLLRDESFAELHSKFCLNEDYKSVFMKNISFDKIDSIIVT             111
Lister  TITT--------------------------------------------------             64
```

-continued

B28R
CLUSTAL O(1.2.4) multiple sequence alignment (SEQ ID NOS 653-655, respectively, in order of appearance)

```
Cop    MKSVLYSYILFLSCIIINGRDIAPHAPSDGKCKDNEYKRHNLCPGTYASALCDSKTNTQC     60
WR     MKSVLYSYILELSCIIINGRDIAPHAPSDGKCKDNEYKRHNLCPGTYASRLCDSKTNTQC     60
Wyeth  -----------------------MHHPMESVKTTN--TNAIICV---REHTLPDYANTQC     32
                               * * :.  . *  ..  :*     .:   . :****

Cop    TPCGSGTFTSRNNHLPACLSCNGRRDRVTLLTIESVNALPDIIVFSKDHPDARHVFPKQN     120
WR     TPCGSGTFTSRNNHLPACLSCNGRRDRVTRLTIESVNALPDIIVFSKDHPDARHVFPKQN     120
Wyeth  TPCGSGTFTSRNNHLPACLSCNGRRDRVTLLTIESVNALPDIIVFSKDHPDARHVFPKQN     92
       ***************************** ******************************

Cop    VE 122
WR     VE 122
Wyeth  V- 93
       *
```

C23L/B29R
CLUSTAL O(1.2.4) multiple sequence alignment (SEQ ID NOS 656-660, respectively, in order of appearance)

```
Cop    --------------MHVPASLQQSSSSSSSCTEEENKHHMGIDVIIKVTKQDQTPTNDKI     46
WR     --------------MHVPASLQQSSSSSSSCTEEENKHHMGIDVIIKVTKQDQTPTNDKI     46
Tian   --------------MHVPASLQQSSSSSSSCTEEENKHHMGIDVIIKVTKQDQTPTNDKI     46
Wyeth  --------------MHVPASLQQ---SSSSCTEEENKHHMGIDVIIKVTKQDQTPTNDKI     43
Lister MKQYIVLACMCLAAAAMPASLQQSSSSSSSCTEEENKHHMGIDVIIKVTKQDQTPTNDKI     60
                       :******   **********************************

Cop    CQSVTEITESESDPDPEVESEDDSTSVEDVDPPTTYYSIIGGGLRMNFGFTKCPQIKSIS     106
WR     CQSVTEITESESDPDPEVESEDDSTSVEDVDPPTTYYSIIGGGLRMNFGFTKCPQIKSIS     106
Tian   CQSVTEITESESDPDPEVESEDDSTSVEDVDPPTTYYSIIGGGLRMNFGFTKCPQIKSIS     106
Wyeth  CQSVTEITESESDPDPEVESEDDSTSVEDVDIPTTYYSIIGGGLRMNFGFTKCPQIKSIS     103
Lister CQSVTEITESESDPDPEVESEDDSTSVEDVDPPTTYYSIIGGGLRMNFGFTKCPQIKSIS     120
       ******************************* ****************************

Cop    ESADGNTVNARLSSVSPGQGKDSPAITREEALAMIKDCEVSIDIRCSEEEKDSDIKTHPV     166
WR     ESADGNTVNARLSSVSPGQGKDSPAITHEEALAMIKDCEVSIDIRCSEEEKDSDIKTHPV     166
Tian   ESADGNTVNARLSSVSPGQGKDSPAITHEEALAMIKDCEVSIDIRCSEEEKDSDIKTHPV     166
Wyeth  ESADGNTVNARLSSVSPGQGKDSPAITHEEALAMIKDCEVSIDIRCSEEEKDSDIKTHPV     163
Lister ESADGNTVNARLSSVSPGQGKDSPAITHEEALAMIKDCEVSIDIRCSEEEKDSDIKTHPV     180
       ***************************:********************************

Cop    LGSNISHKKVSYEDIIGSTIVDTKCVKNLEFSVRIGDMCKESSELEVKDGFKYVDGSASE     226
WR     LGSNISHKKVSYEDIIGSTIVDTKCVKNLEFSVRIGDMCKESSELEVKDGFKYVDGSASE     226
Tian   LGSNISHKKVSYEDIIGSTIVDTKCVENLEFSVRIGDMCKESSELEVKDGFKYVDGSASE     226
Wyeth  LGSNISHKKVSYEDIIGSTIVDTKCVKNLEFSVRIGDMCKESSELEVKDGFKYVDGSASE     223
Lister LGSNISHKKVSYEDIIGSTIVDTKCVKNLEFSVRIGDMCKESSELEVKDGFKYVDGSASE     240
       ************************************************************

Cop    GATDDTSLIDSTKLKACV                                               244
WR     GATDDTSLIDSTKLKACV                                               244
Tian   GATDDTSLIDSTKLKACV                                               244
Wyeth  GATDDTSLIDSTKLKACV                                               241
Lister GATDDTSLIDSTKLKACV                                               258
       ******************
```

Assays for Measuring Virus Characteristics

Assays known in the art to measure the tumor spreading and virulence of a virus include but are not limited to measuring plaque size, syncytia formation, and/or comet assays (EEVs). Assays known in the art to measure the immunostimulatory activity of a virus include but are not limited to NK activation (measured in % CD69 expression), NK degranulation (measured in fold increase of CD107a), and/or T-cell priming assays. Assays known in the art to measure the selectivity of a virus include, but are not limited to, tail pox lesions, biodistribution, and/or body mass measurements.

Examples of Proteins Encoded by Orthopoxvirus Genes

Exemplary proteins encoded by orthopoxvirus genes described in this disclosure are reproduced below in Tables 31-40. As used below, the term "location" refers to the location of the gene with respect to the deleted nucleic acids in exemplary orthopoxvirus vectors described herein. For various genes, amino aid sequence information and protein accession ID numbers are provided.

TABLE 31

Examples of proteins encoded by Copenhagen Vaccinia genes deleted in CopMD5p vector

| SEQ ID NO. | Gene | Protein Accession ID | Amino Acid Sequence | Location |
|---|---|---|---|---|
| SEQ ID NO: 23 | C2L (26% 5') | AAA47999.1 | MESVIFSINGEIIQVNKEIITASPYNFFKRIQDHHLKD EAIILNGINYHAFESLLDYIRWKKINITINNVEMILVA AIIIDVPPVVDLCVKTMIHNINSTNCIRMFNFSKRYGI KKLYNASMSEIINNITAVTSDPEFGKLSKDELTTILS HENVNVNHEDVTAMILLKWIHKNPNDVDIINILHPK FMTNTMRNAISLLGLTISKSTKPVTRNGIKHNIVVIK NSDYISTITHYSPRTEYWTIVGNTDRQFYNANVLHN CLYIIGGMINNRHVYSVSRVDLETICKWKTVTNMSS LKSEVSTCVNDGKLYVIGGLEFSISTGVAEYLKHGT SKWIRLPNLITPRYSGASVFVNDDIYVMGGVYTTYE KYVVLNDVECFTKNRWIKKSPMPRHHSIVYAVEYD GDIYVITGITHETRNYLYKYIVKEDKWIELYMYFNH VGKMFVCSCGDYILIIADAKYEYYPKSNTWNLFDM STRNIEYYDMFTKDETPKCNVTHKSLPSFLSNCEKQ FLQ | Inside Deletion |
| SEQ ID NO: 24 | C1L | AAA48000.1 | MVKNNKISNSCRMIMSTNPNNILMRHLKNLTDDEF KCIIHRSSDFLYLSDSDYTSITKETLVSEIVEEYPDDC NKILAIIFLVLDKDIDVDIETKLKPKPAVRFAILDKM TEDIKLTDLVRHYFRYIEQDIPLGPLFKKIDSYRTRAI NKYSKELGLATEYFNKYGHLMFYTLPIPYNRFFCRN SIGFLAVLSPTIGHVKAFYKFIEYVSIDDRRKFKKEL MSK | Inside Deletion |
| SEQ ID NO: 25 | N1L | AAA48001.1 | MRTLLIRYILWRNDNDQTYYNDDFKKLMLLDELVD DGDVCTLIKNMRMTLSDGPLLDRLNQPVNNIEDAK RMIAISAKVARDIGERSEIRWEESFTILFRMIETYFDD LMIDLYGEK | Inside Deletion |
| SEQ ID NO: 26 | N2L | AAA48002.1 | MTSSAMDNNEPKVLEMVYDATILPEGSSMDPNIMD CINRHINMCIQRTYSSSIIAILNRFLTMNKDELNNTQ CHIIKEFMTYEQMAIDHYGEYVNAILYQIRKRPNQH HTIDLFKKIKRTPYDTFKVDPVEFVKKVIGFVSILNK YKPVYSYVLYENVLYDEFKCFINYVETKYF | Inside Deletion |
| SEQ ID NO: 27 | M1L | AAA48003.1 | MIFVIESKLLQIYRNRNRNINFYTTMDNIMSAEYYLS LYAKYNSKNLDVFRNMLQAIEPSGNNYHILHAYCG IKGLDERFVEELLHRGYSPNETDDDGNYPLHIASKIN NNRIVAMLLTHGADPNACDKHNKSVDTPLYYLSGTDDE VIERINLLVQYGAKINNSVDEEGCGPLLACTDPSER VFKKIMSIGFEARIVDKFGKNHIHRHLMSDNPKASTI SWMMKLGISPSKPDHDGNTPLHIVCSKTVKNVDIID LLLPSTDVNKQNKFGDSPLTLLIKTLSPAHLINKLLS TSNVITDQTVNICIFYDRDDVLEIINDKGKQYDSTDF KMAVEVGSIRCVKYLLDNDIICEDAMYYAVLSEYE TMVDYLLFNHFSVDSVVNGHTCMSECVRLNNPVIL SKLMLHNPTSETMYLTMKAIEKDKLDKSIIIPFIAYF VLMHPDFCKNRRYFTSYKRFVTDYVHEGVSYEVFD DYF | Inside Deletion |
| SEQ ID NO: 28 | M2L | AAA48004.1 | MVYKLVLLFCIASLGYSVEYKNTICPPRQDYRYWY FAAELTIGVNYDINSTIIGECHMSESYIDRNANIVLTG YGLEINMTIMDTDQRFVAAAEGVGKDNICLSVLLFT TQRLDKVHHNISVTITCMEMNCGTTKYDSDLPESIH KSSSCDITINGSCVTCVNLETDPTKINPHYLHPKDKY LYHNSEYGMRGSYGVTFIDELNQCLLDIKELSYDIC YRE | Inside Deletion |
| SEQ ID NO: 29 | HR/K1L | AAA48005.1 | MDLSRINTWKSKQLKSFLSSKDTFKADVHGHSALY YAIADNNVRLVCTLLNAGALKNLLENEFPLHQAAT LEDTKIVKILLFSGMDDSQFDDKGNTALYYAVDSG NMQTVKLFVKKNWRLMFYGKTGWKTSFYHAVML NDVSIVSYFLSEIPSTFDLAILLSCIHTTIKNGHVDMM ILLLDYMTSTNTNNSLLFIPDIKLAIDNKDIEMLQAL FKYDINIYSVNLENVLLDDAEITKMIIEKHVEYKSDS YTKDLDIVKNNKLDEIISKNKELRLMYVNCVKKN | Inside Deletion |
| SEQ ID NO: 30 | SPI-3/K2L | AAA48006.1 | MIALLILSLTCSVSTYRLQGFTNAGIVAYKNIQDDNI VFSPFGYSFSMFMSLLPASGNTRIELLKTMDLRKRD LGPAFTELISGLAKLKTSKYTYTDLTYQSFVDNTVCI KPLYYQQYHRFGLYRLNFRRDAVNKINSIVERRSG MSNVVDSNMLDNNTLWAIINTIYFKGTWQYPFDIT KTRNASFTNKYGTKTVPMMNVVTKLQGNTITIDDE EYDMVRLPYKDANISMYLAIGDNMTHFIDSITAAK LDYWSFQLGNKVYNLKLPKFSIENKRDIKSIAEMM | Inside Deletion |

TABLE 31-continued

Examples of proteins encoded by Copenhagen Vaccinia genes deleted in CopMD5p vector

| SEQ ID NO. | Gene | Protein Accession ID | Amino Acid Sequence | Location |
|---|---|---|---|---|
| | | | APSMFNPDNASFKHMTRDPLYIYKMFQNAKIDVDE QGTVAEASTIMVATARSSPEKLEFNTPFVFIIRHDITG FILFMGKVESP | |
| SEQ ID NO: 31 | K ORF A | AAA48007.1 | MGHIITYCQVHTNISILIRKAHHIIFFVIDCDCISLQFS NYVHHGNRFRTVLISKTSIACFSDIKRILPCTFKIYSI NDCP | Inside Deletion |
| SEQ ID NO: 32 | K ORF B | AAA48008.1 | MGTVFVPYLLVKLALRVLVISNGYCHVPLKYIVLMI AHRVLLSSILESTTLDIPDLRSTIELILLTASRLICFNLY RPNL | Inside Deletion |
| SEQ ID NO: 33 | K ORF B | AAA48009.1 | MLAFCYSLPNAGDVIKGRVYEKDYALYIYLFDYPH SEAILAESVICMHMDRYVEYRDKLVGKTVKVKVIR VDYTKGYIDVNYKRMCRHQ | Inside Deletion |
| SEQ ID NO: 34 | K4L | AAA48010.1 | MNPDNTIAVITETIPIGMQFDKVYLSTFNMWREILSN TTKTLDISSFYWSLSDEVGTNFGTIILNEIVQLPKRG VRVRVAVNKSNKPLKDVERLQMAGVEVRYIDITNI LGGVLHTKFWISDNTHIYLGSANMDWRSLTQVKEL GIAIFNNRNLAADLTQIFEVYWYLGVNNLPYNWKN FYPSYYNTDHPLSINVSGVPHSVFIASAPQQLCTME RTNDLTALLSCIRNASKFVYVSVMNFIPIIYSKAGKI LFWPYIEDELRRSAIDRQVSVKLLISCWQRSSFIMRN FLRSIAMLKSKNIDIEVKLFIVPDADPPIPYSRVNHAK YMVTDKTAYIGTSNWTGNYFTDTCGASINITPDDGL GLRQQLEDIFMRDWNSKYSYELYDTSPTKRCKLLK NMKQCTNDIYCDEIQPEKEIPEYSLE | Inside Deletion |
| SEQ ID NO: 35 | K5L | AAA48011.1 | MGATISILASYDNPNLFTAMILMSPLVNADAVSRLN LLAAKLMGTITPNAPVGKLCPESVSRDMDKVYKYQ YDPLINHEKIKAGFASQVLKATNKVRKIISKINTPRL SYSREQTMRLVMFQVHIISCNMQIVIE | Inside Deletion |
| SEQ ID NO: 36 | K6L | AAA48012.1 | MSANCMFNLDNDYIYWKPITYPKALVFISHGAGKH SGRYDELAENISSLGILVFSHDHIGHGRSNGEKMMI DDFGTARGNY | Inside Deletion |
| SEQ ID NO: 37 | K7R | AAA48013.1 | MATKLDYEDAVFYFVDDDKICSRDSIIDLIDEYITW RNHVIVFNKDITSCGRLYKELMKFDDVAIRYYGIDK INEIVEAMSEGDHYINFTKVHDQESLFATIGICAKITE HWGYKKISESRFQSLGNITDLMTDDNINILILFLEKK LN | Inside Deletion |
| SEQ ID NO: 38 | F1L | AAA48014.1 | MLSMFMCNNIVDYVDDIDNGIVQDIEDEASNNVDH DYVYPLPENMVYRFDKSTNILDYLSTERDHVMMA VRYYMSKQRLDDLYRQLPTKTRSYIDIINIYCDKVS NDYNRDMNIMYDMASTKSFTVYDINNEVNTILMD NKGLGVRLATISFITELGRRCMNPVKTIKMFTLLSHT ICDDCFVDYITDISPPDNTIPNTSTREYLKLIGITAIMF ATYKTLKYMIG | Inside Deletion |
| SEQ ID NO: 39 | DUT/F2L | AAA48015.1 | MFNMNINSPVRFVKETNRAKSPTRQSPGAAGYDLY SAYDYTIPPGERQLIKTDISMSMPKICYGRIAPRSGLS LKGIDIGGGVIDEDYRGNIGVILINNGKCTFNVNTGD RIAQLIYQRIYYPELEEVQSLDSTNRGDQGFSTGLR | Inside Deletion |
| SEQ ID NO: 40 | F3L (75% 3') | AAA48016.1 | MPIFVNTVYCKNILALSMTKKFKTIIDAIGGNIIVNST ILKKLSPYFRTHLRQKYTKNKDPVTRVCLDLDIHSL TSIVIYSYTGKVYIDSHNVVNLLRASILTSVEFITYTCI NFILRDFRKEYCVECYMMGIEYGLSNLLCHTKNFIA KHFLELEDDIIDNFDYLSMKLILESDELNVPDEDYV VDFVIKWYIKRRNKLGNLLLLIKNVIRSNYLSPRGIN NVKWILDCTKIFHCDKQPRKSYKYPFIEYPMNMDQI IDIFHMCTSTHVGEVVVYLIGGWMNNEIHNNAIAVN YISNNWIPIPPMNSPRLYATGIPANNKLYVVGGLPNP TSVERWFHGDAAWVNMPSLLKPRCNPAVASINNVI YVMGGHSETDTTTEYLLPNHDQWQFGPSTYYPHY KSCALVFGRRLFLVGRNAEFYCESSNTWTLIDDPIY PRDNPELIIVDNKLLLIGGFYRGSYIDTIEVYNHHTY SWNIWDGK | Inside Deletion |

TABLE 32

Examples of proteins encoded by Western Reserve Vaccinia genes equivalent to those deleted in CopMD5p vector

| SEQ ID NO. | Gene | Protein Accession ID | AA Sequence | Location |
|---|---|---|---|---|
| SEQ ID NO: 41 | VACWR026 (26% 5') | AAO89305.1 | MESVIFSINGEIIQVNKEIITASPYNFFKRIQDHHLKD EAIILNGINYHAFESLLDYIRWKKINITINNVEMILVA AIIIDVPPVVDLCVKTMIHNINSTNCIRMFNFSKRYGI KKLYNASMSEIINNITAVTSDPEFGKLSKDELTTILS HENVNVNHEDVTAMILLKWIHKNPNDVDIINILHPK FMTNTMRNAISLLGLTISKSTKPVTRNGIKHNIVVIK NSDYISTITHYSPRTEYWTIVGNTDRQFYNANVLHN CLYIIGGMINNRHVYSVSRVDLETKKWKTVTNMSS LKSEVSTCVNDGKLYVIGGLEFSISTGVAEYLKHGT SKWIRLPNLITPRYSGASVFVNDDIYVMGGVYTTYE KYVVLNDVECFTKNRWIKKSPMPRHHSIVYAVEYD GDIYVITGITHETRNYLYKYIVKEDKWIELYMYFNH VGKMFVCSCGDYILIIADAKYEYYPKSNTWNLFDM STRNIEYYDMFTKDETPKCNVTHKSLPSFLSNCEKQ FLQ | Inside Deletion |
| SEQ ID NO: 42 | VACWR027 | AAO89306.1 | MVKNNKIQKNKISNSCRMIMSTDPNNILMRHLKNL TDDEFKCIIHRSSDFLYLSDSDYTSITKETLVSEIVEE YPDDCNKILAIIFLVLDKDIDVDIKTKLKPKPAVRFAI LDKMTEDIKLTDLVRHYFRYIEQDIPLGPLFKKIDSY RTRAINKYSKELGLATEYFNKYGHLMFYTLPIPYNR FFCRNSIGFLAVLSPTIGHVKAFYKFIEYVSIDDRRKF KKELMSK | Inside Deletion |
| SEQ ID NO: 43 | VACWR028 | AAO89307.1 | MRTLLIRYILWRNDNDQTYYNDNFKKLMLLDELVD DGDVCTLIKNMRMTLSDGPLLDRLNQPVNNIEDAK RMIAISAKVARDIGERSEIRWEESFTILFRMIETYFDD LMIDLYGEK | Inside Deletion |
| SEQ ID NO: 44 | VACWR029 | AAO89308.1 | MTSSAMDNNEPKVLEMVYDATILPEGSSMDPNIMD CINRHINMCIQRTYSSSIIAILDRFLMMNKDELNNTQ CHIIKEFMTYEQMAIDHYGGYVNAILYQIRKRPNQH HTIDLFKRIKRTRYDTFKVDPVEFVKKVIGFVSILNK YKPVYSYVLYENVLYDEFKCFINYVETKYF | Inside Deletion |
| SEQ ID NO: 45 | VACWR030 | AAO89309.1 | MIFVIESKLLQIYRNRNRNINFYTTNIDNIMSAEYYLS LYAKYNSKNLDVFRNMLQAIEPSGNNYHILHAYCG IKGLDERFVEELLHRGYSPNETDDDGNYPLHIASKIN NNRIVAMLLTHGADPNACDKHNKTPLYYLSGTDDE VIERINLLVQYGAKINNSVDEEGCGPLLACTDPSER VFKKIMSIGFEARIVDKFGKNHIHRHLMSDNPKASTI SWMMKLGISPSKPDHDGNTPLHIVCSKTVKNVDIID LLLPSTDVNKQNKFGDSPLTLLIKTLSPAHLINKLLS TSNVITDQTVNICIFYDRDDVLEIINDKGKQYDSTDF KMAVEVGSIRCVKYLLDNDIICEDAMYYAVLSEYE TMVDYLLFNHFSVDFVVNGHTCMSECVRLNNPVIL SKLMLHNPTSETMYLTMKAIEKDRLDKSIIIPFIAYF VLMHPDFCKNRRYFTSYKRFVTDYVHEGVSYEVFD DYF | Inside Deletion |
| SEQ ID NO: 46 | VACWR031 | AAO89310.1 | MVYKLVLLFCIASLGYSVEYKNTICPPRQDYRYWY FAAELTIGVNYDINSTIIGECHMSESYIDRNANIVLTG YGLEINMTIMDTDQRFVAAAEGVGKDNKLSVLLFT TQRLDKVHHNISVTITCMEMNCGTTKYDSDLPESIH KSSSCDITINGSCVTCVNLETDPTKINPHYLHPKDKY LYHNSEYSMRGSYGVTFIDELNQCLLDIKELSYDIC YRE | Inside Deletion |
| SEQ ID No:47 | VACWR032 | AAO89311.1 | MDLSRINTWKSKQLKSFLSSKDAFKADVHGHSALY YAIADNNVRLVCTLLNAGALKNLLENEFPLHQAAT LEDTKIVKILLFSGLDDSQFDDKGNTALYYAVDSGN MQTVKLFVKKNWRLMFYGKTGWKTSFYHAVMLN DVSIVSYFLSEIPSTFDLAILLSCIHITIKNGHVDMMIL LLDYMTSTNTNNSLLFIPDIKLAIDNICDIEMLQALFK YDINIYSANLENVLLDDAEIAKMIIEKHVEYKSDSYT KDLDIVKNNKLDEIISKNKELRLMYVNCVKKN | Inside Deletion |
| SEQ ID NO: 48 | SPI-3 | AAO89312.1 | MIALLILSLTCSVSTYRLQGFTNAGIVAYKNIQDDNI VFSPFGYSFSMFMSLLPASGNTRIELLKTMDLRKRD LGPAFTELISGLAKLKTSKYTYTDLTYQSFVDNTVCI KPSYYQQYHRFGLYRLNFRRDAVNKINSIVERRSG MSNVVDSNMLDNNTLWAIINTIYFKGIWQYPFDITK TRNASFTNKYGTKTVPMMNVVTKLQGNTITIDDEE YDMVRLPYKDANISMYLAIGDNMTHFTDSITAAKL | Inside Deletion |

TABLE 32-continued

Examples of proteins encoded by Western Reserve Vaccinia genes equivalent to those deleted in CopMD5p vector

| SEQ ID NO. | Gene | Protein Accession ID | AA Sequence | Location |
|---|---|---|---|---|
| | | | DYWSFQLGNKVYNLKLPKFSIENKRDIKSIAEMMAP SMFNPDNASFKHMTRDPLYIYKMFQNAKIDVDEQG TVAEASTIMVATARSSPEKLEFNTPFVFIIRHDITGFI LFMGKVESP | |
| SEQ ID NO: 49 | VACWR034 | AAO89313.1 | MLAFCYSLPNAGDVIKGRVYEKDYALYIYLFDYPH FEAILAESVKMHMDRYVEYRDKLVGKTVKVKVIR VDYTKGYIDVNYKRMCRHQ | Inside Deletion |
| SEQ ID NO: 50 | VACWR035 | AAO89314.1 | MNPDNTIAVITETIPIGMQFDKVYLSTFNMWREILSN TTKTLDISSFYWSLSDEVGTNFGTIILNKIVQLPKRG VRVRVAVNKSNKPLKDVERLQMAGVEVRYIDITNI LGGVLHTKFWISDNTHIYLGSANMDWRSLTQVKEL GIAIFNNRNLAADLTQIFEVYWYLGVNNLPYNWKN FYPSYYNTDHPLSINVSGVPHSVFIASAPQQLCTME RTNDLTALLSCIRNASKFVYVSVMNFIPIIYSKAGNI LFWPYIEDELRRAAIDRQVSVKLLISCWQRSSFIMRN FLRSIAMLKSKNINIEVKLFIVPDADPPIPYSRVNHAK YMVTDKTAYIGTSNWTGNYFTDTCGASINITPDDGL GLRQQLEDIFMRDWNSKYSYELYDTSPTKRCRLLK NMKQCINDIYCDEIQPEKEIPEYSLE | Inside Deletion |
| SEQ ID NO: 51 | VACWR036 | AAO89315.1 | MQHANCNREIKIYEGAKHHLHKETDEVKKSVMKEI ETWIFNRVK | Outside Deletion |
| SEQ ID NO: 52 | VACWR037 | AAO89316.1 | MTLVQHVVTIKSTYWVIPWELASYDNPNLFTAMIL MSPLVNADAVSKLNLLAAKLMGTITLNAPVGKLCP ESVSRDMDKVYKYQYDPLINHEKIKAGFASQVLKA TNKVRKIISKINTPRLSYSREQTIRLAMF | Inside Deletion |
| SEQ ID NO: 53 | VACWR038 | AAO89317.1 | MSANCMFNLDNDYIYWKPITYPKALVFISHGAGKH SGRYDELAENISSLGILVFSHDHIGHGRSNGEKMMI DDFGTARGNY | Inside Deletion |
| SEQ ID NO: 54 | VACWR039 | AAO89318.1 | MATKLDYEDAVFYFVDDDKICSRDSIIDLIDEYITW RNHVIVFNKDITSCGRLYKELMKFDDVAIRYYGIDK INEIVEAMSEGDHYINFTKVHDQESLFATIGICAKITE HWGYKKISESRFQSLGNITDLMTDDNINILILFLEKK LN | Inside Deletion |
| SEQ ID NO: 55 | VACWR040 | AAO89319.1 | MLSMFMCNNIVDYVDDIDNGIVQDIEDEASNNVDH DYVYPLPENMVYRFDKSTNILDYLSTERDHVMMA VRYYMSKQRLDDLYRQLPTKTRSYIDIINIYCDKVS NDYNRDMNIMYDMASTKSFTVYDINNEVNTILMD NKGLGVRLATISFITELGRRCMNPVETIKMFTLLSHT ICDDYFVDYITDISPPDNTIPNTSTREYLKLIGITAIMF ATYKTLKYMIG | Inside Deletion |
| SEQ ID NO: 56 | DUT | AAO89320.1 | MFNMNINSPVRFVKETNRAKSPTROQSPYAAGYDLY SAYDYTIPPGERQLIKTDISMSMPKFCYGRIAPRSGL SLKGIDIGGGVIDEDYRGNIGVILINNGKCTFNVNTG DRIAQLIYQRIYYPELEEVQSLDSTNRGDQGFGSTGLR | Inside Deletion |
| SEQ ID NO: 57 | VACWR042 (75% 3') | AAO89321.1 | MPIFVNTVYCKNILALSMTKKFKTIIDAIGGNIIVNST ILKKLSPYFRTHLRQKYTKNKDPVTWVCLDLDIHSL TSIVIYSYTGKVYIDSHNVVNLLRASILTSVEFIIYTCI NFILRDFRKEYCVECYMMGIEYGLSNLLCHTKNFIA KHFLELEDDIIDNFDYLSMKLILESDELNVPDEDYV VDFVIKWYIKRRNKLGNLLLLIKNVIRSNYLSPRGIN NVKWILDCTKIFHCDKQPRKSYKYPFIEYPMNMDQI IDIFHMCTSTHVGEVVYLIGGWMNNEIHNNAIAVN YISNNWIPIPPMNSPRLYASGIPANNKLYVVGGLPNP TSVERWFHGDAAWVNMPSLLKPRCNPAVASINNVI YVMGGHSETDTTTEYLLPNHDQWQFGPSTYYPHY KSCALVFGRRLFLVGRNAEFYCESSNTWTLIDDPIY PRDNPELIIVDNKLLLIGGFYRESYIDTIEVYNHHTYS WNIWDGK | Inside Deletion |

TABLE 33

Examples of proteins encoded by Tian Tan Vaccinia genes equivalent to those deleted in CopMD5p vector

| SEQ ID NO | Gene | Protein Accession ID | AA Sequence | Location |
|---|---|---|---|---|
| SEQ ID NO: 58 | TC2L (26% 5') | AAF33878.1 | MESVIFSINGEIIQVNKEIITASPYNFFKRIQDHHLKD EAIILNGINYHAFESLLDYIRWKKINITINNVEMILVA AIIIDVPPVVDLCVKTMIHNINSTNCIRMFNFSKQYGI KKLYNASMSEIINNITAVTSDPEFGKLSKDELTTILS HEDVNVNHEDVTAMILLKWIHKNPNDVDIINILHPK FMTNTMRNAISLLGLTISKSTKPVTRNGIKHNIVVIK NSDYISTITHYSPRTEYWTIVGNTDRQFYNANVLHN CLYIIGGMINNRHVYSVSRVDLETKKWKTVTNMSS LKSEVSTCVNNGKLYVIGGLEFSISTGVAEYLKHGT SKWIRLPNLITPRYSGASVFVNDDIYVMGGVYTTYE KYVVLNDVECFTKNRWIKKSPMPRHHSIVYAVEYD GDIYVITGITHETRNYLYKYIVKEDKWIELYMYFNH VGKMFVCSCGDYILIIADAKYEYYPKSNTWNLFDM STRNIEYYDMFTKDETPKCNVTHKSLPSFLSNCEKQ FLQ | Inside Deletion |
| SEQ ID NO: 59 | TC1L | AAF33879.1 | MVKNNKISNSCRMIMSTDPNNILMRHLKNLTDDEF KCIIHRSSDFLYLSDSDYTSITKETLVSEIVEEYPDDC NKILAIIFLVLDKDIDVDIKTKLKPKPAVRFAILDKM TEDIKLTDLVRHYFRYIEQDIPLGPLFKKIDSYRTRAI NKYSKELGLATEYFNKYGHLMFYTLPIPYNRFFCRN SIGFLAVLSPTIGHVKAFYKFIEYVSIDDRRKFKKEL MSK | Inside Deletion |
| SEQ ID NO: 60 | TN1L | AAF33880.1 | MRTLLIRYILWRNDNDQTYYNDDFKKLMLLDELVD DGDVCTLIKNMRMTLSDGPLLDRLNQPVNNIEDAK RMIAISAKVARDIGERSEIRWEESFTILFRMIETYFDD LMIDLYGEK | Inside Deletion |
| SEQ ID NO: 61 | TN2L | AAF33881.1 | MTSSAMDNNEPKVLEMVYDATILPEGSSMDPYIMD CINRHINMCIQRTYSSSIIAILDRFLMMNKDELNNTQ CHIIKNL | Inside Deletion |
| SEQ ID NO: 62 | TM1L | AAF33882.1 | MIFVIESKLLQIYRNRNRNINFYTTMDNIMSAEYYLS LYAKYNSKNLDVFRNMLQAIEPSGNNYHILHAYCG IKGLDERFVEELLHRGYSPNETDDDGNYPLHIASKIN NNRIVAMLLTHGADPNACDKHNKTPLYYLSGTDDE VIERINLLVQYGAKINNSVDEEGCGPLLACTDPSER VFKKIMSIGFEARIVDKFGKNHIHRHLMSDNPKASTI SWMMKLGISPSKPDHDGNTPLHIVCSKTVKNVDIID LLLPSTDVNKQNKFGDSPLTLLIKTLSPAHLINKLLS TSNVITDQTVNICIFYDRDDVLEIINDKGKQYDSTDF KMAVEVGSIRCVKYLLDNDIICEDAMYYAVLSEYE TMVDYLLFNHFSVDFVVNGHTCMSECVRLNNPVIL SKLMLHNLTSETMYLTMKAIEKDRLDKSIIIPFIAYF VLMHPDFCKNRRYFTSYKRFVTDYVHEGVSYEVFD DYF | Inside Deletion |
| SEQ ID NO: 63 | TM2L | AAF33883.1 | MSSSTRLPVLVLAAELTIGVNYDINSTIIGECHMSES YIDRNANIVLTGYGLEINMTIMDTDQRFVAAAEGV GKDNKLSVLLFTTQRLDKVHHNISVTITCMEMNCG TTKYDSDLPESIHKSSSCDITINGSCVTCVNLETDPT KINPHYLHPKDKYLYHNSEYGMRGSYGVTFIDELN QCLLDIKELSYDICYRE | Inside Deletion |
| SEQ ID NO: 64 | TK1L | AAF33884.1 | MLQALFKYDINIYSANLENVLLDDAEIAKMIIEKHV EYKSDSYTKDLDIVKNNKLDEIISKNKELRLMYVNC VKKN | Inside Deletion |
| SEQ ID NO: 65 | TK2L | AAF33885.1 | MDLSRINTWKSKQLKSFLSSKDTFKADVHGHSALY YAIADNNVRLVCTLLNSGALKNLLENEFPLHQAAT LEDTKIVKILLFSGLDDSQFDDKGNTALYYAVDSGN MQTVKLFVKKNWRLMFYGKTGWKTSFYHAVMLN DVSIVSYFLSEIPSTFDLAILLSCIHITIKNGHVDMMIL LLDYMTVDKHQ | Inside Deletion |
| SEQ ID NO: 66 | TK3L | AAF33886.1 | MIALLILSLACSASAYRLQGFTNAGIVAYKNIQDDNI VFSPFGYSFSMFMSLLPASGNTRIELLKTMDLRKRD LGPAFTELISGLAKLKTSKYTYTDLTYQSFVDNTVCI KPSYYQQYHRFGLYRLNFRRDAVNKINSIVERRSG MSNVVDSNMLDNNTLWAIINTIYFKGTWQYPFDIT KTRNASFTNKYGTKTVPMMNVVTKLQGNTITIDDE EYDMVRLPYKDANISMYLAIGDNMTHFTDSITAAK DYWSFQLGNKVYNLKLPKFSIENKRDIKSIAEMMAP | Inside Deletion |

TABLE 33-continued

Examples of proteins encoded by Tian Tan Vaccinia genes equivalent to those deleted in CopMD5p vector

| SEQ ID NO | Gene | Protein Accession ID | AA Sequence | Location |
|---|---|---|---|---|
| | | | SMFNPDNASFKHMTRDPLYIYKMFQNAKIDVDEQG TVAEASTIMVATARSSPEELEFNTPFVFIIRHDITGFIL FMGKVESP | |
| SEQ ID NO: 67 | ORFR | AAF33887.1 | MGHIITYCQVHTNISILIRKAYHIIFFVIDCDCISLQFS NYVHHGNRFRTVLISKTSIACFSDIKRILPCTFKIYSI NDCP | |
| SEQ ID NO: 68 | TK4L | AAF33888.1 | MLAFCYSLPNAGDVIKGRVYEKDYALYIYLFDYPH SEAILAESVKMHMDRYVEYRDKLVGKTVKVKVIR VDYTKGYIDVNYKRMCRHQ | Inside Deletion |
| SEQ ID NO: 69 | TK6L | AAF33889.1 | MTLVQHVVTIKSTYWVIPWELASYDNPNLFTAMIL MSPLVNADAVSKLNLLAAKLMGTITLNAPVGKLCP ESVSRDMDKVYKYQYDPLINHEKIKAGFASQVLKA TNKVRKIISKINTPRLSYSREQTIRLAMF | Inside Deletion |
| SEQ ID NO: 70 | TK8R | AAF33890.1 | MATKLDYEDAVFYFVDDDKICSRDSIIDLIDEYITW RNHVIVFNKDITSCGRLYKELMKFDDVAIRYYGIDK INEIVEAMSEGDHYINFTKVHDQESLFATIGICAKITE HWGYKKISESRFQSLGNITDLMTDDNINILILFLEKK LN | Inside Deletion |
| SEQ ID NO: 71 | TF1L | AAF33891.1 | MLSMFMCNNIVDYVDDIDNGIVQDIEDEASNNVDR DYVYPLPENMVYRFDKSTNILDYLSTERDHVMMA VRYYMSKQRLDDLYRQLPTKTRSYIDIINIYCDKVS NDYNRDMNIMYDMASTKSFTVYDINNEVNTILMD NKGLGVRLATISFITELGRRCMNPVKTIKMFTLLSHT ICDDCFVDYITDISPPDNTIPNTSTREYLKLIGITAIMF ATYKTLKYMIG | Inside Deletion |
| SEQ ID NO: 72 | TF2L | AAF33892.1 | MFNMNINSPVRFVKETNRAKSPTRQSPGAAGYDLY SAYDYTIPPGERQLIKTDISMSMPKICYGRIAPRSGLS LKGIDIGGGVIDEDYRGNIGVILINNGKCTFNVNTGD RIAQLIYQRIYYPELEEVQSLDSTDRGDQGFGSTGLR | Inside Deletion |
| SEQ ID NO: 73 | TF3L (75% 3') | AAF33893.1 | MPIFVNTVYCKNILALSMTKKFKTIIDAIGGNIIVNST ILKKLSPYFRTHLRQKYTKNKDPVTRVCLDLDIHSL TSIVIYSYTGKVYIDSHNVVNLLRASILTSVEFIIYTCI NFILRDFRKEYCVECYMMGIEYGLSNLLCHTKNFIA KHFLELEDDIIDNFDYLSMKLILESDELNVPDEDYV VDFVIKWYIKRRNKLGNLLLLIKNVIRSNYLSPRGIN NVKWILDCTKIFHCDKQPRKSYKYPFIEYPMNMDQI IDIFHMCTSTHVGEVVYLIGGWMNNEIHNNAIAVN YISNNWIPIPPMNSPRLYASGIPANNKLYVVGGLPNP TSVERWFHGDAAWVNMPSLLKPRCNPAVASINNVI YVMGGHSETDTTTEYLLPNHDQWQFGPSTYYPHY KSCALVFGRRLFLVGRNAEFYCESSNTWTLIDDPIY PRDNPELIIVDNKLLLIGGFYRESYIDTIEVYNHHTYS WNIWDGK | Inside Deletion |
| | TK5L ORFR TK7L | | | |

TABLE 34

Examples of proteins encoded by Wyeth Vaccinia genes equivalent to those deleted in CopMD5p vector

| SEQ ID NO | Gene | Protein Accession ID | Amino Acid Sequence | Location |
|---|---|---|---|---|
| SEQ ID NO: 74 | VAC_DPP20_035 (26% 5') | AEY74729.1 | MESVTFSINGEIIQVNKEIITASPYNFFKRIQEHHINDE VIILNGINYHAFESLLDYMRWKKINITINNVEMILVA AVIIDVTPVVDLCVKTMIHNINSTNCIRMFNFSKRYG IKKLYNASMSEIINNITAVTSDPEFGKLSKDELTTILS HEDVNVNHEDVTAMILLKWIHKNPNDVDIINILHPK FMTNTMRNAISLLGLTISKSTKPVTRNGIKHNIVVIK NSDYISTITHYSPRTEYWTIVGNTDRQFYNANVLHN | Inside Deletion |

TABLE 34-continued

Examples of proteins encoded by Wyeth Vaccinia genes equivalent to those deleted in CopMD5p vector

| SEQ ID NO | Gene | Protein Accession ID | Amino Acid Sequence | Location |
|---|---|---|---|---|
| | | | CLYIIGGMINNRHVYSVSRVDLETKKWKTVTNMSS LKSEVSTCVNNGKLYVIGGLEFSISTGVAEYLKHGT SKWIRLPNLITPRYSGASVFVNDDIYVMGGVYTTYE KYVVLNDVECFTKNRWIKKSPMPRHHSIVYAVEYD GDIYAITGITHETRNYLYKYIVKEDKWIELYMYFNH VGKMFVCSCGDYILIIADAKYEYYPKSNTWNLFDM STRNIEYYDMFTKDETHKSLPSFLSNCEKQFLQ | |
| SEQ ID NO: 75 | VAC_DPP10_036 | AEY74730.1 | MVKNNKISNSCRMIMSTNPNNILMRHLKNLTDDEF KCIIHRSSDFLYLSDRDYTSITKETLVSEIVEEYPDDC NKILAIIFLVLDKDIDVDIKTKLKPKPAVRFAILDKM TEDIKLTDLVRHYFRYIEQDIPLGPLFKKIDSYRTRAI NKYSKELGLATEYFNKYGHLMFYTLPIPYNRFFCRN SIGFLAVLSPTIGHVKAFYKFIEYVSIDDRRKFKKEL MSK | Inside Deletion |
| SEQ ID NO: 76 | N1L | AEY74731.1 | MRTLLIRYILWRNDNDQTYYNDDFKKLMLLDELVD DGDVCTLIKNMRMTLSDGPLLDRLNQPVNNIEDAK RMIAISAKVARDIGERSEIRWEESFTILFRMIETYFDD LMIDLYGEK | Inside Deletion |
| SEQ ID NO: 77 | VAC_DPP11_038 | AEY74732.1 | MTSSAMDNNEPKVLEMVYDATILPEGSSMDPNIIDC INRHINMCIQRTYSSSIIAILDRFLTMNKDELNNTQC HIIKEFMTYEQMAIDHYGGYVNAILYQIRKRPNQHH TIDLFKKIKRTRYDTFKVDPVEFVKKVIGFVSILNKY KPVYSYVLYENVLYDEFKCFIDYVETKYF | Inside Deletion |
| SEQ ID NO: 78 | VAC_DPP11_039 | AEY74733.1 | MLHNPTSETMYLTMNAIKKDKLDKSIIIPFIAYFVLM HPDFCKNRRYFTSYKRFVTDYVHEGVSYEVFDDYF | Not Present |
| SEQ ID NO: 79 | VAC_DPP12_040 | AEY74734.1 | MSIGFEARIVDKFGKNHIHRHLMSDNPKASTISWM MKLGISPSKPDHDGNTPLHIVCSKTVKYVDIIDLLLP STDVNKQNKFGDSPLTLLIKTLSLAHINKLLSTSNV ITDQTVNICIFYDRDDVLEIINDKGKQYDFKMAVEV GSIKCVKYLLDNDIICEDAMYYAVLSEYKTMVDYL LFNHFSVDSVVNGHTCMSECVKLNNRHFIEADVT | Inside Deletion |
| SEQ ID NO: 80 | VAC_DPP12_041 | AEY74735.1 | MIFVLESKLLQIYRNRNRNINFYTTMDNIMSAEYYLS LYAKYNSKNLDVFRNMLQAIEPSGNNYHILHAYCG IKGLDERFVEELLHRGYSPNETDDDGNYPLHIASKIN NNRIVAMLLTHGADPNACDKHNKTPLYYLSGTDDE VIERINLLVQYGAKINN | Not Present |
| SEQ ID NO: 81 | VAC_DPP12_042 | AEY74736.1 | MVYKLVLLFCIASLGYSVEYKNTICPPRQDYRYWY FAAELTIGVNYDINSTIIGECHMSESYIDRNANIVLTG YGLEINMTIMDTDQRFVAAAEGVGKDNKLSVLLFT TQRLDKVHHNISVTITCMEMNCGTTKYDSDLPESIH KSSSCDITINGSCVTCVNLETDPTKINPHYLHPKDKY LYHNSEYGMRGSYGVTFIDELNQCLLDIKELSYDIC YRE | Inside Deletion |
| SEQ ID NO: 82 | VAC_DPP10_043 | AEY74737.1 | MDLSRINTWKSKQLKSFLSSKDTFKADVHGHSALY YAIADNNVRLVCTLLNAGALKNLLENEFPLHQAAT LEDTKIVKILLFSGLDDSQFDDKGNTALYYAVDSGN MQTVKLFVKKNWRLMFYGKTGWKTSFYHAVMLN DVSIVSYFLSEIPSTFDLAILLSCIHITIKNGHVDMMIL LLDYMTSTNTNNSLLFIPDIKLAIDNKDIEMLQALFK YDINIYSANLENVLLDDAEIAKMIIEKHVEYKSDSYT KDLDIVKNNKLDEIISKNKELRLMYVNCVKKN | Inside Deletion |
| SEQ ID NO: 83 | VAC_DPP20_044 | AEY74738.1 | MIALLILSLTCSVSTYRLQGFTNAGIVAYKNIQDDNI VFSPFGYSFSMFMSLLPASGNTRIELLKTMDLRKRD LGPAFTELISGLAKLKTSKYTYTDLTYQSFVDNTVCI KPSYYQQYHRLNFRRDAVNKINSIVERRSGMSNVV DSNMLDNNTLWAIINTIYFKGIWQYPFDITKTRNAS FTNKYGTKTVPMMNVVTKLQGNTITIDDKEYDMV RLPYKDANISMYLAIGDNMTHFTDSITAAKLDYWS FQLGNKVYNLKLPKFSIENKRDIKSIAEMMAPSMFN PDNASFKHMTRDPLYIYKMFQNAKIDVDEQGTVAE ASTIMVATARSSPEKLEFNTPFVFIIRHDITGFILFMG KVESP | Inside Deletion |

TABLE 34-continued

Examples of proteins encoded by Wyeth Vaccinia genes equivalent to those deleted in CopMD5p vector

| SEQ ID NO | Gene | Protein Accession ID | Amino Acid Sequence | Location |
|---|---|---|---|---|
| SEQ ID NO: 84 | VAC_DPP10_045 | AEY74739.1 | MLAFCYSLPNAGDVIKGRVYENDYALYIYLFDYPH FEAILAESVKMHMDRYVEYRDKLVGKTVKVKVIR VDYTKGYIDVNYKRMCRHQ | Inside Deletion |
| SEQ ID NO: 85 | K4L | AEY74740.1 | MNPDNTIAVITETIPIGMQFDKVYLSTFNMWREILSN TTKTLDISSFYWSLSDEVGTNFGTIILNEIVQLPKRG VRVRVAVNKSNKPLKDVERLQMAGVEVRYIDITNI LGGVLHTKFWISDNTHIYLGSANMDWRSLTQVKEL GIAIFNNRNLAADLTQIFEVYWYLGVNNLPYNWKN FYPSYYNTDHPLSINVSGVPHSVFIASAPQQLCTME RTNDLTALLSCIRNASKFVYVSVMNFIPIIYSKAGKI LFWPYIEDELRRSAIDRQVSVKLLISCWQRSSFIMRN FLRSIAMLKSKNINIEVKLFIVPDADPPIPYSRVNHAK YMVTDKTAYIGTSNWTGNYFTDTCGASINITPDDGL GLRQQLEDIFMRDWNSKYSYELYDTSPTKRCKLLK NMKQCTNDIYCDEIQPEKEIPEYSLE | Inside Deletion |
| SEQ ID NO: 86 | VAC_DPP20_047 | AEY74741.1 | MGATISILASYDNPNLFTAMILMSPLVNADAVSKLN LLAAKLMGTITPNAPVGKLCPESVSRDMDKVYKYQ YDPLINHEKIKAGFASQVLKATNKVRKIISKINTPPT LILQGTNNEISDVLGAYYFMQHANCNREIKIYEGAK HHLHKETDEVKKSVMKEIETWIFNRVK | Inside Deletion |
| SEQ ID NO: 87 | List034/ VAC_DPP20_048 | AEY74742.1 | MSANCMFNLDNDYIYWKPITYPKALVFISHGAGKH SGRYDELAENISSLGILVFSHDHIGHGRSNGEKMMI DDFGTARGNY | Inside Deletion |
| SEQ ID NO: 88 | K7R/ VAC_DPP20-49 | AEY74743.1 | MATKLDYEDAVFYFVDDDKICSRDSIIDLIDEYITW RNHVIVFNKDITSCGRLYKELMKFDDVAIRYYGIDK INEIVEAMSEGDHYINFTKVHDQESLFATIGICAKITE HWGYKKISESRFQSLGNITDLMTDDNINILILFLEKK LN | Inside Deletion |
| SEQ ID NO: 89 | LIVPclone14_046/ VAC_DPP20_047 | AEY74744.1 | MLSMFMCNNIVDYVDDIDNGIVQDIEDEASNNVDH DYVYPLPENMVYRFDKSTNILDYLSTERDHVMMA VRYYMSKQRLDDLYRQLPTKTRSYIDIINIYCDKVS NDYNRDMNIMYDMASTKSFTVYDINNEVNTILMD NKGLGVRLATISFITKLGRRCMNPVKTIKMFTLLSH TICDDCFVDYITDISPPDNTIPNTSTREYLKLIGITAIM FATYKTLKYMIG | Inside Deletion |
| SEQ ID NO: 90 | F2L/ VAC_DPP20_051 | AEY74745.1 | MFNMNINSPVRFVKETNRAKSPTRQSPGAAGYDLY SAYDYTIPPGERQLIKTDISMSMPKICYGRIAPRSGLS LKGIDIGGGVIDEDYRGNIGVILINNGKCTFNVNTGD RIAQLIYQRIYYPELEEVQSLDSTNRGDQGFGSTGLR | Inside Deletion |
| SEQ ID NO: 91 | F3L (75% 3') | AEY74746.1 | MPIFVNTVYCKNILALSMTKKFKTIIDAIGGNIIVNST ILKKLSPYFRTHLRQKYTKNKDPVTRVCLDLDIHSL TSIVIYSYTGKVYIDSHNVVNLLRASILTSVEFIIYTCI NFILRDFRKEYCVECYMMGIEYGLSNLLCHTKNFIA KHFLELEDDIIDNFDYLSMKLILESDELNVPDEDYV VDFVIKWYIKRRNKLGNLLLLIKNVIRSNYLSPRGIN NVKWILDCTKIFHCDKQPRKSYKYPFIEYPMNMDQI IDIFHMCTSTHVGEVVYLIGGWMNNEIHNNAIAVN YISNNWIPIPPMNSPRLYASGIPANNKLYVVGGLPNP TSVERWFHGDAAWVNMPSLLKPRCNPAVASINNVI YVMGGHSETDTTTEYLLPNHDQWQFGPSTYYPHY KSCALVFGRRLFLVGRNAEFYCESSNTWTLIDDPIY PRDNPELIIVDNKILLIGGFYRESYIDTIEVYNHHTYS WNIWDGK | Inside Deletion |

TABLE 35

Examples of proteins encoded by Lister Vaccinia genes equivalent to those deleted in CopMD5p vector

| SEQ ID NO | Gene | Protein Accession ID | Amino Acid Sequence | Location |
|---|---|---|---|---|
| SEQ ID NO: 92 | List023 (26% 5') | ABD52473.1 | MESVIFSINGEIIQVNKEIITASPYNFFKRIQDHHLKD EAIILNGINYHAFESLLDYMRWKKINITINNVEMILV AAIIIDVPPVVDLCVKTMIHNINFTNCIRMFNFSKRY GIKKLYNASMSEIINNITAVTSDPEFGKLSKDELTTIL SHEDVNVNHEDVTAMILLKWIHKNPNDVDIINILHP KFMTNTMRNAISLLGLTISKSTKPVTRNGIKHNIVVI KNSDYISTITHYSPRTEYWTIVGNTDRQFYNANVLH NCLYIIGGMINNRHVYSVSRVDLKTKKWKTVTNMS SLKSEVSTCVNDGKLYVIGGLEFSISTGVAEYLKHG TSKWIRLPNLITPRYSGASVFVNDDIYVMGGVYTTY EKYVVLNDVECFTKNRWIKKSPMPRHHSIVYAVEY DGDIYVITGITHETRNYLYKYIVKEDKWIELYMYFN HVGKMFVCSCGDYILIIADAKYEYYPKSNTWNLFD MSTRNIEYYDMFTKDETPKCNVTHKSLPSFLSNCEK QFLQ | Inside Deletion |
| SEQ ID NO: 93 | C1L/List024 | ABD52474.1 | MVKNNKISNSCRMIMSTNPNNILMRHLKNLTDDEF KCIIHRSSDFLYLSDSDYTSITKETLVSEIVEEYPDDC NKILAIIFLVLDKDIDVDIETKLKPKPAVRFAILDKM TADIKLTDLVRHYFRYIEQDIPLGPLFKKIDSYRTRAI NKYSKELGLATEYFNKYGHLMFYTLPIPYNRFFCRN SIGFLAVLSPTIGHVKAFYKFIEYVSIDDRRKFKKEL MSK | Inside Deletion |
| SEQ ID NO: 94 | N1L/List025 | ABD52475.1 | MRTLLIRYILWRNDNDQTYYNDDFKKLMLLDELVD DGDVCTLIKNMRMTLSDGPLLDRLNQPVNNIEDAK RMIAISAKVARDIGERSEIRWEESFTILFRMIETYFDD LMIDLYGEK | Inside Deletion |
| SEQ ID NO: 95 | List026 | ABD52476.1 | MTSSAMDNNEPKVLEMVYDATILPEGSSMDPNIMD CINRHINMCIQRTYSSSIIAILDRFLTMNKDELNNTQ CHIIKEFMTYEQMAIDHYGEYVNAILYQIRKRPNQH HTIDLFKKIKRTRYDTFKVDPVEFVKKVIGFVSILNK YKPVYSYVLYENVLYDEFKCFIDYVETKYF | Inside Deletion |
| SEQ ID NO: 96 | List027 | ABD52477.1 | MIFVIESKLLQIYRNRNINFYTTMDNIMSAEYYLSLY AKYNSKNLDVFRNMLQAIEPSGNNYHILHAYCGIK GLDERFVEELLHRGYSPNETDDDGNYPLHIASKINN NRIVAMLLTHGADPNACDKQHKTPLYYLSGTDDEV IERINLLVQYGAKINNSVDEEGCGPLLACTDPSERVF KKIMSIGFEARIVDKFGKNHIHRHLMSDNPKASTIS WMMKLGISPSKPDHDGNTPLHIVCSKTVKNVDIIDL LLPSTDVNKQNKFGDSPLTLLIKTLSPAHLINKLLST SNVITDQTVNICIFYDRDDVLEIINDKGKQYDSTDFK MAVEVGSIRCVKYLLDNDIICEDAMYYAVLSEYET MVDYLLFNHFSVDSVVNGHTCMSECVRLNNPVILS KLMLHNPTSETMYLTMKAIEKDRLDKSIIIPFIAYFV LMHPDFCKNRRYFTSYKRFVTDYVHEGVSYEVFDD YF | Inside Deletion |
| SEQ ID NO: 97 | List028 | ABD52478.1 | MVYKLVLLFCIASLGYSVEYKNTICPPRQDYRYWY FAAELTIGVNYDINSTIIGECHMSESYIDRNANIVLTG YGLEINMTIMDTDQRFVAAAEGVGKDNKLSVLLFT TQRLDKVHHNISVTITCMEMNCGTTKYDSDLPESIH KSSSCDITINGSCVTCVNLETDPTKINPHYLHPKDKY LYHNSEYGMRGSYGVTFIDELNQCLLDIKELSYDIC YRE | Inside Deletion |
| SEQ ID NO: 98 | K1L/List029 | ABD52479.1 | MDLSRINTWKSKQLKSFLSSKDAFKADINGHSALY YAIADNNVRLVCTLLNAGALKNLLENEFPLHQAAT LEDTKIVKILLFSGLDDSQFDDKGNTALYYAVDSGN MQTVKLFVKKNWRLMFYGKTGWKTSFYHAVMLN DVSIVSYFLSEIPSTFDLAILLSCIHITIKNGHVDMMIL LLDYMTSTNTNNSLLFIPDIKLAIDNKDIEMLQALFK YDINIYSANLENVLLDDAEIAKMIIEKHVEYKSDSYT KDLDIVKNNKLDEIISKNKELKLMYVNCVKKN | Inside Deletion |
| SEQ ID NO: 99 | List030 | ABD52480.1 | IELLKTMDLRKRDLGPAFTELISGLAKLKTSKYTYT DLTYQSFVDNTVCIKPSYYQQYHRFGLYRLNFRRD AVNKINSIVERRSGMSNVVDSNMLDNNTLWAIINTI YFKGIWQYPFDITKTRNASFTNKYGTKTVPMMNVV TKLQGNTITIDDEEYDMVRLPYKDANISMYLAIGDN MTHFTDSITAAKLDYWSSQLGNKVYNLKLPKFSIEN | Inside Deletion |

TABLE 35-continued

Examples of proteins encoded by Lister Vaccinia genes equivalent to those deleted in CopMD5p vector

| SEQ ID NO | Gene | Protein Accession ID | Amino Acid Sequence | Location |
|---|---|---|---|---|
| | | | KRDIKSIAEMMAPSMFNPDNASFKHMTRDPLYIYK<br>MFQNAKIDVDEQGTVAEASTIMVATARSSPEKLEFN<br>TPFVFIIRHDITGFILFMGKVESP | |
| SEQ ID NO: 100 | K3L/List031 | ABD52483.1 | MLAFCYSLPNAGDVIKGRVYENDYALYIYLFDYPH<br>SEAILAESVKMHMDRYVEYRDKLVGKTVKVKVIR<br>VDYTKGYIDVNYKRMCRHQ | Inside Deletion |
| SEQ ID NO: 101 | K4L/List032 | ABD52484.1 | MNPDNTIAVITETIPIGMQFDKVYLSTFNMWREILSN<br>TTKTLDISSFYWSLSDEVGTNFGTIILNEIVQLPKRG<br>VRVRVAVNKSNKPLKDVERLQMAGVEVRYIDITNI<br>LGGVLHTKFWISDNTHIYLGSANMDWRSLTQVKEL<br>GIAIFNNRNLAADLTQIFEVYWYLGVNNLPYNWKN<br>FYPSYYNTDHPLSINVSGVPHSVFIASAPQQLCTME<br>RTNDLTALLSCIRNASKFVYVSVMNFIPIIYSKAGKI<br>LFWPYIEDELRRSAIDRQVSVKLLISCWQRSSFIMRN<br>FLRSIAMLKSKNINIEVKLFIVPDADPPIPYSRVNHAK<br>YMVTDKTAYIGTSNWTGNYFTDTCGASINITPDDGL<br>GLRQQLEDIFMRDWNSKYSYELYDTSPTKRCKLLK<br>NMKQCTNDIYCDEIQPEKEIPEYSLE | Inside Deletion |
| SEQ ID NO: 102 | List033 | ABD52485.1 | MGHSMGATISILASYDNPNLFTAMILMSPLVNADA<br>VSRLNLLAAKLMGTITPNAPVGKLCPESVSRDMDK<br>VYKYQYDPLINHEKIKAGFASQVLKATNKVRKIISKI<br>NTPPTLILQGTNNKISDVLGAYYFMQHANCNREIKI<br>YEGAKHHLHKETDEVKKSVMKEIETWIFNRVK | Outside Deletion |
| SEQ ID NO: 103 | List034 | ABD52486.1 | MSANCMFNLDNDYIYWKPITYPKALVFISHGAGKH<br>SGRYDELAENISSLGILVFSHDHIGHGRSNGEKMMI<br>DDFGTARGNY | Inside Deletion |
| SEQ ID NO: 104 | K7R/List035 | ABD52487.1 | MATKLDYEDAVFYFVDDDKICSRDSIIDLIDEYITW<br>RNHVIVFNKDITSCGRLYKELMKFDDVAIRYYGIDK<br>INEIVEAMSEGDHYINFTKVHDQESLFATIGICAKITE<br>HWGYKKISESRFQSLGNITDLMTDDNINILILFLEKK<br>LN | Inside Deletion |
| SEQ ID NO: 105 | F1L/List036 | ABD52489.1 | MLSMFMCNNIVDYVDDIDNGIVQDIEDEASNNVDH<br>DYVYPLPENMVYRFDKSTNILDYLSTERDHVMMA<br>VRYYMSKQRLDDLYRQLPTKTRSYIDIINIYCDKVS<br>NDYNRDMNIMYDMASTKSFTVYDINNEVNTILMD<br>NKGLGVRLATISFITELGRRCMNPVKTIKMFTLLSHT<br>ICDDCFVDYITDISPPDNTIPNTSTREYLKLIGITAIMF<br>ATYKTLKYMIG | Inside Deletion |
| SEQ ID NO: 106 | List037 | ABD52490.1 | MFNMNINSPVRFVKETNRAKSPTRQSPGAAGYDLY<br>SAYDYTIPPGERQLIKTDISMSMPKFCYGRIAPRSGL<br>SLKGIDIGGGV1DEDYRGNIGVILINNGKCTFNVNTG<br>DRIAQLIYQRIYYPELEEVQSLDSTNRGDQGFGSTGLR | Inside Deletion |
| SEQ ID NO: 107 | List038 (75% 3') | ABD52491.1 | MPIFVNTVYCKNILALSMTKKFKTIIDAIGGNIIVNST<br>ILKKLSPYFRTHLRQKYTKNKDPVTRVCLDLDIHSL<br>TSIVIYSTGKVYIDSHNVVNLLRASILTSVEFIIYTCI<br>NFILRDFRKEYCVECYMMGIEYGLSNLLCHTKNFIA<br>KHFLELEDDIIDNFDYLSIKLILESDELNVPDEDYVV<br>DFVIKWYIKRRNKLGNLLLLIKNVIRSNYLSPRGINN<br>VKWILDCTKIFHCDKQPRKSYKYPFIEYPMNMDQII<br>DIFHMCTSTHVGEVVYLIGGWMNNEIHNNAIAVNY<br>ISNNWIPIPPMNSPRLYASGIPANNKLYVVGGLPNPT<br>SVERWFHGDAAWVNMPSLLKPRCNPAVASINNVIY<br>VMGGHSETDTTTEYLLPNHDQWQFGPSTYYPHYKS<br>CALVFGRRLFLVGRNAEFYCESSNTWTLIDDPIYPR<br>DNPELIIVDNKLLLIGGFYRESYIDTIEVYNHHTYSW<br>NIWDGK | Inside Deletion |

TABLE 36

Examples of proteins encoded by Copenhagen Vaccinia genes deleted in CopMD3p vector

| SEQ ID NO | Gene | Protein Accession ID | Amino Acid Sequence | Location |
|---|---|---|---|---|
| SEQ ID NO: 108 | B14R (41% 3') | AAA49211.1 | MNHCLLAISAVYFKAKWLTPFEKEFTSDYPFYVSPT EMVDVSMMSMYGELFNHASVKESFGNFSIIELPYV GDTSMMVILPDKIDGLESIEQNLTDTNFKKWCNSLD AMFIDVHIPKFKVTGSYNLVDTLVKSGLTEVFGSTG DYSNMCNLDVSVDAMIHKTYIDVNEEYTEAAAATC ALVSDCASTITNEFCVDHPFIYVIRHVDGKILFVGRY CSPTTNC | Inside Deletion |
| SEQ ID NO: 109 | B15R | AAA49212.1 | MTANFSTHVFSPQHCGCDRLTSIDDVKQCLTEYIYW SSYAYRNRQCAGQLYSTLLSFRDDAELVFIDIRELV KNMPWDDVKDCTEIIRCYIPDEQKTIREISAIIGLCA YAATYWGGEDHPTSNSLNALFVMLEMLNYVDYNII FRRMN | Inside Deletion |
| SEQ ID NO: 110 | B ORF E | AAA48213.1 | MYNSSIHTPEYDVIIHVIEHLKHHKQCVQTVTSGMV FTSPVSSSICTKSDDGRNLSDGFLLIRYITTDDFCTIF DIIPRHIFYQLANVDEH | Inside Deletion |
| SEQ ID NO: 111 | B16R | AAA48214.1 | MSILPVIFLPIFFYSSFVQTFNASECIDKGXYFASFME LENEPVILPCPQINTLSSGYNILDILWEKRGADNDRII PIDNGSNMLILNPTQSDSGIYICITTNETYCDMMSLN LTIVSVSESNIDFISYPQIVNERSTGEMVCPNINAFIAS NVNADIIWSGHRRLRNKRLKQRTPGIITIEDVRKND AGYYTCVLEYIYGGKTYNVTRIVKLEVRDKIIHPTM QLPEGVVTSIGSNLTIACRVSLRPPTTDADVFWISNG MYYEEDDGDGDGRISVANKIYMTDKRRVITSRLNI NPVKEEDATTFTCMAFTIPSISKTVTVSIT | Inside Deletion |
| SEQ ID NO: 112 | B ORF F | AAA48215.1 | MVIIPGVRCLSLLFLRRRCPLHIISAFTLLAINALILGH TISPVDLSFTICGYEIKSIFDSETDTIVKFNDIMSQ | Inside Deletion |
| SEQ ID NO: 113 | B17L | AAA48216.1 | MSRKFMQVYEYDREQYLDEFIEDRYNDSFITSPEYY SAEKYMCRYTTLNHNCVNVRRCALDSKLLHDIITN CKIYNNIELVRATKFVYYLDLIKCNWVSKVGDSVL YPVIFITHTSTRNLDKVSVKTYKGVKVKKLNRCAD HAIVINPFVKFKLTLPNKTSHAKVLVTFCKLRTDITP VEAPLPGNVLVYTFPDINKRIPGYIHVNIEGCIDGMI YINSSKFACVLKLHRSMYRIPPFPIDICSCCSQYTND DIEIPIHDLIKDVAIFKNKETVYYLKLNNKTIARFTYF NNIDTAITQEHEYVKIALGIVCKLMINNMHSIVGVN HSNTFVNCLLEDNV | Inside Deletion |
| SEQ ID NO: 114 | B18R | AAA48217.1 | MSRRLIYVLNINRKSTHKIQENEIYTYFSHCNIDHTS TELDFVVKNYDLNRRQHVTGYTALHCYLYNNYFT NDVLKILLNHDVNVTMKTSSGRMPVYILLTRCCNIS HDVVIDMIDKDKNHLSHRDYSNLLLEYIKSRYMLL KEEDIDENIVSTLLDKGIDPNFKQDGYTALHYYYLC LAHVYKPGECRKPITIKKAKRIISLFIQHGANLNALD NCGNTPFHLYLSIEMCNNIHMTKMLLTFNPNFKICN NHGLTPILCYITSDYIQHDILVMLIHHYETNVGEMPI DERRMIVFEFIKTYSTRPADSITYLMNRFKNINIYTR YEGKTLLHVACEYNNTQVIDYLIRINGDINALTDNN KHATQLIIDNKENSPYTINCLLYILRYIVDKNVIRSLV DQLPSLPIFDIKSFEKFISYCILLDDTFYDRHVKNRDS KTYRYAFSKYMSFDKYDGIITKCHDETMLLKLSTVL DTTLYAVLRCHNSRKLRRYLTELKKYNNDKSFKIY SNIMNERYLNVYYKDMYVSKVYDKLFPVFTDKNC LLTLLPSEIIYEILYMLTINDLYNISYPPTKV | Inside Deletion |
| SEQ ID NO: 115 | B19R | AAA48218.1 | MTMKMMVHIYFVSLSLLLLLFHSYAIDIENEITEFFN KMRDTLPAKDSKWLNPACMFGGTMNDMATLGEPF SAKCPPIEDSLLSHRYKDYVVKWERLEKNRRRQVS NKRVKHGDLWIANYTSKFSNRRYLCTVTTKNGDC VQGIVRSHIKKPPSCIPKTYELGTHDKYGIDLYCGIL YAKHYNNITWYKDNKEINIDDIKYSQTGKELIIHNPE LEDSGRYDCYVHYDDVRIKNDIVVSRCKILTVIPSQ DHRFKLILDPKINVTIGEPANITCTAVSTSLLIDDVLI EWENPSGWLIGFDFDVYSVLTSRGGITEATLYFENV TEEYIGNTYKCRGHNYYFEKTLTTTVVLE | Inside Deletion |
| SEQ ID NO: 116 | B20R | AAA48219.1 | MDEDTRLSRYLYLTDREHINVDSIKQLCKISDPNAC YRCGCTALHEYFYNYRSVNGKYKYRYNGYYQYYS SSDYENYNEYYYDDYDRTGMNSESDSESDNISIKTE YENEYEFYDETQDQSTQHNDL | Inside Deletion |

TABLE 36 -continued

Examples of proteins encoded by Copenhagen Vaccinia genes deleted in CopMD3p vector

| SEQ ID NO | Gene | Protein Accession ID | Amino Acid Sequence | Location |
|---|---|---|---|---|
| SEQ ID NO: 117 | B21R | AAA48220.1 | MSLESFIITTFNNNSSTNIDNMCHLYVKVCPSSLLFR LFVECCDINKLVEGTTPLHCYLMNEGFESSVLKNLL KEYVMNTFNVHDIHYTNI | Inside Deletion |
| SEQ ID NO: 118 | B22R | AAA48221.1 | MISLSFLIHNPLKKWKLKPSISINGYRSTFTMAFPCA QFRPCHCHATKDSLNTVADVRHCLTEYILWVSHRW THRESAGSLYRLLISFRTDATELFGGELKDSLPWDNI DNCVEIIKCFIRNDSMKTAEELRAIIGLCTQSAIVSGR VFNDKYIDILLMLRKILNENDYLTLLDHIRTAKY | Inside Deletion |
| SEQ ID NO: 119 | B23R | AAA48222.1 | MIAFIIFREIGIISTRIAMDYCGRECTILCRLLDEDVTY KKIKLEIETCHNLSKHIDRRGNNALHCYVSNKCDTD IK1VRLLLSRGVERLCRNNEGLTPLGAYSKHRYVKS QIVHLLISSYSNSSNELKSNINDFDLSSDNIDLRLLKY LIVDKRIRPSKNTNYAINGLGLVDIYVTTPNPRPEVL LWLLKSECYSTGYVFRTCMYNSDMCKNSLHYYISS HRESQSLSKDVIKCLINNNVSIHGRDEGGSLPIQYY WSFSTIDIEIVKLLLIKDVDTCRVYDVSPILEAYYLN KRFRVTPYNVDMEIVNLLIERRHTLVDVMRSITSYD SREYNHYIIDNILKRFRQQDESIVQAMLINYLHYGD MVVRCMLDNGQQLSSARLLC | Inside Deletion |
| SEQ ID NO: 120 | B24R | AAA48223.1 | MYGLILSRFNNCGYHCYETILIDVFDILSKYMDDID MIDNENKTLLYYAVDVNNIQFAKRLLEYGASVTTS RSIINTAIQKSSYQRENKTRIVDLLLSYHPTLETMIDA FNRDIRYLYPEPLFACIRYALILDDDFPSKVSMISPVII RN | Inside Deletion |
| SEQ ID NO: 121 | B ORF G | AAA48224.1 | MRRCIHIKERKIHMTNIVDRNVTFILTVVHKYVRYV PHTVANDAHNLVHLAHLIHFIIYFFIIRDVRKKKKKK KKNRTIYFFSNVYARHIK | Inside Deletion |
| SEQ ID NO: 122 | B25R | AAA48225.1 | MSRINITKKIYCSVFLFLFLFLSYISNYEKVNDEMYE MGEMDEIVSIVRDSMWYIPNVFMDDGKNEGHVSV NNVCHMYFTFFDVDTSSHLFKLVIKHCDLNKRGNS PLHCYTMNTRFNPSVLKILLHHGMRNFDSKDEKGH HYLIHSLSIDNKIFDILTDTIDDFSKSSDLLLCYLRYK FNGSLNYYVLYKGSDPNCADEDELTSLHYYCKHIST FYKSNYYKLSHTKMRAEKRFIYAIIDYGANINAVTH LPSTVYQT | Inside Deletion |
| SEQ ID NO: 123 | B26R | AAA48226.1 | MEQTLTRLHTYLQQYTKHSPRVVYALLSRGYVIILI VHPSWNDCATGHILIMLLNWHEQKEEGQHLLYLFI KHNQGYTLNILRYLLDRFDIQKDEYIYRLSKL | Inside Deletion |
| SEQ ID NO: 124 | B27R | AAA48227.1 | MLPHTSDTTSTFRLKTVFDLVFENRNIIYKADVVNDI IHHRLKVSLPMIKSLFYKMSEFSPYDDYYVKKILAY CLLRDESFAELHSKFCLNEDYKSVFMKNISFDKIDSII VT | Inside Deletion |
| SEQ ID NO: 125 | B28R | AAA48228.1 | MKSVLYSYILFLSCIIINGRDIAPHAPSDGKCKDNEY KRHNLCPGTYASRLCDSKTNTQCTPCGSGTFTSRNN HLPACLSCNGRRDRVTLLTIESVNALPDIIVFSKDHP DARHVFPKQNVE | Inside Deletion |
| SEQ ID NO: 126 | C23L/B29R (44% 5') | AAA48229.1 | MHVPASLQQSSSSSSSCTEEENKHHMGIDVIIKVTK QDQTPTNDKKQSVTEITESESDPDPEVESEDDSTSV EDVDPPTTYYSIIGGGLRMNFGFTKCPQIKSISESAD GNTVNARLSSVSPGQGKDSPAITREEALAMIKDCEV SIDIRCSEEEKDSDIKTHPVLGSNISHKKVSYEDIIGST IVDTKCVKNLEFSVRIGDMCKESSELEVKDGFKYVD GSASEGATDDTSLIDSTKLKACV | Inside Deletion |

TABLE 37

Examples of proteins encoded by Western Reserve Vaccinia genes equivalent to those deleted in CopMD3p vector

| SEQ ID NO | Gene | Protein Accession ID | Amino Acid Sequence | Location |
|---|---|---|---|---|
| SEQ ID NO: 127 | SPI-2/B13R/VACWR195 (26% 3') | AAO89474.1 | MDIFREIASSMKGENVFISPASISSVLTILYYGANGST AEQLSKYVEKEENMDKVSAQNISFKSINKVYGRYS AVFKDSFLRKIGDKFQTVDFTDCRTIDAINKCVDIFT EGKINPLLDEPLSPDTCLLAISAVYFKAKWLTPFEKE FTSDYPFYVSPTEMVDVSMMSMYGKAFNHASVKE SFGNFSIIELPYVGDTSMMVILPDKIDGLESIEQNLTD TNFKKWCNSLEATFIDVHIPKFKVTGSYNLVDTLVK SGLTEVFGSTGDYSNMCNSDVSVDAMIHKTYIDVN EEYTEAAAATCALVSDCASTITNEFCVDHPFIYVIRH VDGKILFVGRYCSPTTNC | Inside Deletion |
| SEQ ID NO: 128 | VACWR196 | AAO89475.1 | MTANFSTHVFSPQHCGCDRLTSIDDVRQCLTEYIYW SSYAYRNRQCAGQLYSTLLSFRDDAELVFIDIRELV KNMPWDDVKDCAEIIRCYIPDEQKTIREISAIIGLCA YAATYWGGEDHPTSNSLNALFVMLEMLNYVDYNII FRRMN | Inside Deletion |
| SEQ ID NO: 129 | VACWR197 | AAO89476.1 | MSILPVIFLSIFFYSSFVQTFNAPECIDKGQYFASFME LENEPVILPCPQINTLSSGYNILDILWEKRGADNDRII PIDNGSNMLILNPTQSDSGIYICITTNETYCDMMSLN LTIVSVSESNIDLISYPQIVNERSTGEMVCPNINAFIAS NVNADIIWSGHRRLRNKRLKQRTPGIITIEDVRKND AGYYTCVLEYIYGGKTYNVTRIVKLEVRDKIIPSTM QLPDGIVTSIGSNLTIACRVSLRPPTTDADVFWISNG MYYEEDDGDGNGRISVANKIYMTDKRRVITSRLNI NPVKEEDATTFTCMAFTIPSISKTVTVSIT | Inside Deletion |
| SEQ ID NO: 130 | VACWR198 | AAO89477.1 | MSRKFMQVYEYDREQYLDEFIEDRYNDSFITSPEYY SAEKYMCRYTTLNHNCINVRRCALDSKLLHDIITNC KIYNNIELVRATKFVYYLDLIKCNWVSKVGDSVLYP VIFITHTSTRNLDKVSVKTYKGVKVKKLNRCADHAI VINPFVKFKLTLPNKTSHAKVLVTFCKLKTDITPVEA PLPGNVLVYTFPDINKRIPGYIHLNIEGCIDGMIYINS SKFACVLKLHRSMYRIPPFPIDKSCCSQYINYDIEIPI HDLIKDVAIFKNKETVYYLKLNNKTIARFTYFNNID TAITQEHEYVKIALGIVCKLMINNMHSIVGVNHSNT FVNCLLEDNV | Inside Deletion |
| SEQ ID NO: 131 | VACWR199 | AAO89478.1 | MSRRLIYVLNINRESTHKIQENEIYTYFSHCNIDHTST ELDFVVKNYDLNRRQPVTGYTALHCYLYNNYFTN DVLKILLNHGVDVTMKTSSGRMPVYILLTRCCNISH DVVIDMIDKDKNHLLHRDYSNLLLEYIKSRYMLLK EEDIDENIVSTLLDKGIDPNFKQDGYTALHYYYLCL AHVYKPGECRKPITIKKAKRIISLFIQHGANLNALDN CGNTPFHLYLSIEMCNNIHMTKMLLTFNPNFEICNN HGLTPILCYITSDYIQHDILVMLIHHYETNVGEMPID ERRIIVFEFIKTYSTRPADSITYLMNRFKNIDIYTRYE GKTLLHVACEYNNTHVIDYLIRINGDINALTDNNKH ATQLIIDNKENSPYTINCLLYILRYIVDKNVIRSLVDQ LPSLPIFDIKSFEKFISYCILLDDTFYNRHVRNRDSKT YRYAFSKYMSFDKYDGIITKCHKETILLKLSTVLDT TLYAVLRCHNSKKLRRYLTELKKYNNDKSFKIYSNI MNERYLNVYYKDMYVSKVYDKLFPVFTDKNCLLT LLPSEIIYEILYMLTINDLYNISYPPTKV | Inside Deletion |
| SEQ ID NO: 132 | B18R/VACWR200 | AAO89479.1 | MTMKMMVHIYFVSLLLLLFHSYAIDIENEITEFFNK MRDTLPAKDSKWLNPACMFGGTMNDIAALGEPFS AKCPPIEDSLLSHRYKDYVVKWERLEKNRRRQVSN KRVKHGDLWIANYTSKFSNRRYLCTVTTKNGDCV QGIVSHIRKPPSCIPKTYELGTHDKYGIDLYCGILY AKHYNNITWYKDNKEINIDDIKYSQTGKELIIHNPEL EDSGRYDCYVHYDDVRIKNDIVVSRCKILTVIPSQD HRFKLILDPKINVTIGEPANITCTAVSTSLLIDDVLIE WENPSGWLIGFDFDVYSVLTSRGGITEATLYFENVT EEYIGNTYKCRGHNYYFEKTLTTTVVLE | Inside Deletion |
| SEQ ID NO: 133 | VACWR201 | AAO89480.1 | MHVIDVDVRLYMSTFIIIDQSTENTSIDTTVTINIIYL AIMKIIMNIIMMIMIELV | Not Present |
| SEQ ID NO: 134 | VACWR202 | AAO89481.1 | MNSESDNISIKTEYEFYDETQDQSTQLVGYDIKLKT NEDDFMANIDQWVSMII | Not Present |

TABLE 37-continued

| Examples of proteins encoded by Western Reserve Vaccinia genes equivalent to those deleted in CopMD3p vector | | | | |
|---|---|---|---|---|
| SEQ ID NO | Gene | Protein Accession ID | Amino Acid Sequence | Location |
| SEQ ID NO: 135 | VACWR203 | AAO89482.1 | MEMYPRHRYSKHSVFKGFSDKVRKNDLDMNVVKE LLSNGASLTIKDSSNKDPITVYFRRTIMNLEMIDERK YIVHSYLKNYKNFDYPFFRKLVLTNKHCLNNYYNIS DSKYGTPLHILASNKKLITPNYMKLLVYNGNDINAR GEDTQMRTPLHKYLCKFVYHNIEYGIRYYNEKIIDA FIELGADLTIPNDDGMIPVVYCIHSNAEYGYNNITNI KIIRKLLNLSRRASHNLFRDRVMHDYISNTYIDLECL DIIRSLDGFDINGYFEGRTPLHCAIQHNFTQIAKYLL DRGADIVVPNTLIIHQYIQ | Inside Deletion |
| SEQ ID NOS 677 and 136 | VACWR204 | AAO89483.1 | MLNFSLCLYPVFILNKLVLRTQSIILHTINNASIKNR \\\\\\ and \\\\\\ MEEDTNISNKVIRYNTVNNIWETLPNFWTGTINPGV VSHKDDIYVVCDIKDEKNVKTCIFRYNTNTYNGWE LVTTTESRLSALHTILYNNTIMMLHCYESYMLQDTF NVYTREWNHMCHQHSNSYIMYNILPIY | Not Present |
| SEQ ID NO: 137 | SPI-1/ VACWR205 | AAO89484.1 | MDIFKELILKHTDENVLISPVSILSTLSILNHGAAGST AEQLSKYIENMNENTPDDNNDMDVDIPYCATLATA NKIYGSDSIEFHASFLQKIKDDFQTVNFNNANQTKE LINEWVKTMTNGKINSLLTSPLSINTRMTVVSAVHF KAMWKYPFSKHLTYTDKFYISKNIVTSVDMMVSTE NNLQYVHINELFGGFSIIDIPYEGNSSMVIILPDDIEGI YNIEKNITDEKFKKWCGMLSTKSIDLYMPKFKVEM TEPYNLVPILENLGLTNIFGYYADFSKMCNETITVEK FLHTTFIDVNEEYTEASAVTGVFMTNFSMVYRTKV YINHPFMYMIKDNTGRILFIGKYCYPQ | Outside Deletion |
| SEQ ID NO: 138 | C13L/ VACWR206 | AAO89485.1 | MMIYGLIACLIFVTSSIASPLYIPVIPPISEDKSFNSVE VLVSLFRDDQKDYTVTSQFNNYTIDTKDWTIGVLST PDGLDIPLTNITYWSRFTIGRALFKSESEDIFQKKMSI LGVSIECKKSSTLLTFLTVRKMTRVFNKFPDMAYYR GDCLKAVYVTMTYKNTKTGETDYTYLSNGGLPAY YRNGVDG | Outside Deletion |
| SEQ ID NO: 139 | VACWR207 | AAO89486.1 | MKLFTQNDRYFGLLDSCTHIFCITCINIWHKTRRETG ASDNCPICRTRFRNITMSKFYKLVN | Outside Deletion |
| SEQ ID NO: 140 | p28/ VACWR208 | AAO89487.1 | MEFDPAKINTSSIDHVTILQYIDEPNDIRLTVCIIRNIN NITYYINITKINTHLANQFRAWKKRIAGRDYMTNLS RDTGIQQSKLTETIRNCQKNRNIYGLYIHYNLVINVV IDWITDVIVQSILRGLVNWYIANNTYTPNTPNNTTTI SELDIIKILDKYEDVYRVSKEKECGICYEVVYSKR | Outside Deletion |
| SEQ ID NO: 141 | C10L/ VACWR209 | AAO89488.1 | MDIYDDKGLQTIKLFNNEFDCIRNDIRELFKHVTDS DSIQLPMEDNSDIIENIRKILYRRLKNVECVDIDSTIT FMKYDPNDDNKRTCSNWVPLTNNYMEYCLVIYLE TPICGGKIKLYHPTGNIKSDKDIMFAKTLDFKSKKVL TGRKTIAVLDISVSYNRSMTTIHYNDDVDIDIHTDK NGKELCYCYITIDDHYLVDVETIGVIVNRSGKCLLV NNHLGIGIVKDKRISDSFGDVCMDTIFDFSEARELFS LTNDDNRNIAWDTDKLDDDTDIWTPVTEDDYKFLS RLVLYAKSQSDTVFDYYVLTGDTEPPTVFIFKVTRF YFNMPK | Outside Deletion |
| SEQ ID NO: 142 | VGF-1/ VACWR210 | AAO89489.1 | MSMKYLMLLFAAMIIRSFADSGNAIETTSPEITNATT DIPAIRLCGPEGDGYCLHGDCIHARDIDGMYCRCSH GYTGIRCQHVVLVDYQRSENPNTTTSYIPSPGIMLV LVGIIIITCCLLSVYRFTRRTKLPIQDMVVP | Outside Deletion |
| SEQ ID NO: 143 | VACWR211 | AAO89490.1 | MDEIVRIVRDSMWYIPNVFMDDGKNEGHVSVNNV CHMYFTFFDVDTSSHLFKLVIKHCDLNKRGNSPLHC YTMNTRFNPSVLKILLHHGMRNFDSKDEKGHHYQS ITRSLIY | Inside Deletion |
| SEQ ID NO: 144 | C20L/ VACWR212 | AAO89491.1 | MLFYLEEPIRGYVIILIVHPSWNDCATGHILIMLLNW HEQKEEGQHLLYLFIKHNQGYTLNILRYLLDRFDIQ KDEYYNTAFQNCNNNVASYIGYDINLPTKDGIRLGV | Inside Deletion |
| SEQ ID NO: 145 | VACWR213 | AAO89492.1 | MLPHTSDTTSTFRLKTVFDLVFENRNIIYKADVVNDI IHHRLKVSLPMIKSLFYKMSLPTTITT | Inside Deletion |

TABLE 37-continued

Examples of proteins encoded by Western Reserve Vaccinia genes equivalent to those deleted in CopMD3p vector

| SEQ ID NO | Gene | Protein Accession ID | Amino Acid Sequence | Location |
|---|---|---|---|---|
| SEQ ID NO: 146 | VACWR214 | AAO89493.1 | MYDDLIEQCHLSMERKSKLVDKALNKLESTIGQSRL SYLPPEIMRNII | Outside Deletion |
| SEQ ID NO: 147 | B28R/ VACWR215 | AAO89494.1 | MKSVLYSYILFLSCIIINGRDIAPHAPSDGKCKDNEY KRHNLCPGTYASRLCDSKTNTQCTPCGSGTFTSRNN HLPACLSCNGRRDRVTRLTIESVNALPDIIVFSKDHP DARHVFPKQNVE | Inside Deletion |
| SEQ ID NO: 148 | VACWR216 | AAO89495.1 | MDSLRPVVVVNWIQINFHIDIVKGITGYGFAFICGRD GVRICSETTRRTDDVSGYSVSYSTFCLGNTCLASG | Outside Deletion |
| SEQ ID NO: 149 | VACWR217 | AAO89496.1 | MWKLICIQLTTTTGLSESISTSELTITMNHKDCNPVF REEYFSVLNKVATSGFFTGERCAL | Outside Deletion |
| SEQ ID NO: 150 | B29R/ VACWR218 (44% 5') | AAO89497.1 | MHVPASLQQSSSSSSSCTEEENKHHMGIDVIIKVTK QDQTPTNDKICQSVTEITESESDPDPEVESEDDSTSV EDVDPPTTYYSIIGGGLRMNFGFTKCPQIKSISESAD GNTVNARLSSVSPGQGKDSPAITHEEALAMIKDCEV SIDIRCSEEEKDSDIKTHPVLGSNISHKKVSYEDIIGST IVDTKCVKNLEFSVRIGDMCKESSELEVKDGFKYVD GSASEGATDDTSLIDSTKLKACV | Inside Deletion |

TABLE 38

Examples of proteins encoded by Tian Tan Vaccinia genes equivalent to those deleted in CopMD3p vector

| SEQ ID NO | Gene | Protein Accession ID | Amino Acid Sequence | Location |
|---|---|---|---|---|
| SEQ ID NO: 151 | TF3L (41% 3') | AAF34083.1 | MNHCLLAISAVYFKAKWLTPFEKEFTSDYPFYVSPT EMVDVSMMSMYGKAFNHASVKESFGNFSIIELPYV GDTSMMVILPDKIDGLESIEQNLTDTNFKKWCDFM DAMFIDVHIPKFKVTGSYNLVDTLVKSGLTEVFGST GDYSNMCNLDVSVDAMIHKTYIDVNEEYTEAAAA TCALVSDCASTITNEFCVDHPFIYVIRHVDGKILFVG RYCSPTTNC | Inside Deletion |
| SEQ ID NO: 152 | TB15R | AAF34084.1 | MTANFSTHVFSPQHCGCDRLTSIDDVKQCLTEYIYW SSYAYRNRQCAGQLYSTLLSFRDDAELVFIDIRELV KNMPWDDVKDCTEIIRCYIPDEQKTIREISAIIGLCA YAATYWGGEDHPTSNSLNALFVMLEMLNYVDYNII FRRMN | Inside Deletion |
| SEQ ID NO: 153 | ORFL | AAF34085.1 | MYNSSIHTPEYDVIIHVIEHLKHHKQCVQTVTSGMV FTSPVSSSICTKSDDGRNLSDGFLLIRYITTDDFCTIF DIIPRHIFYQLANVDEH | |
| SEQ ID NO: 154 | TB16R | AAF34086.1 | MELENEPVILPCPQINTLSSGYNILDILWEKRGADND RIIPIDNGSNMLILNPTQSDSGIYICITTNETYCDMMS LNLTIVSVLESNIDLISYPQIVNERSTGEMVCPNINAF IASNVNADIIWSGHRRLRNKRLKQRTPGIITIEDVRK NDAGYYTCVLEYIYRGKTYNVTRIVKLEVRDKIIPS TMQLPDGIVTSIGSNLTIACRVSLRPPTTDADVFWIS NGMYYEEDDGDGNGRISVANKIYMTDKRRVITSRL NINPVKEEDATTFTCMAFTIPSISKTVTVSIT | Inside Deletion |
| SEQ ID NO: 155 | ORFL | AAF34087.1 | MVIIPGVRCLSLLFLRRRCPLHIISAFTLLAINALILGH TISPVDLSFTICGYEIRSIFDSKTDTIVKFNDIMSQ | |
| SEQ ID NO: 156 | TB17L | AAF34088.1 | MSRKFMQVYEYDREQYLDEFIEDRYNDSFITSPEYY SAEKYMCRYTTLNHNCVNVRRCALDSKLLHDIITN CKIYNNIELVRATKFVYYLDLIKCNWVSKVGDSVL YPVIFITHTSTRNLDKVSVKTYKGVKVKKLNRCAD HAIVINPFVKFKLTLPNKTSHAKVLVTFCKLRTDITQ IEAPLSGNVLVYTFPNINKRIPGYIHVNIEGCIDGMIY INSSKFACVLKLHRSMYRIPPFPIDKSCCSQYTNGDI | Inside Deletion |

TABLE 38-continued

Examples of proteins encoded by Tian Tan Vaccinia genes equivalent to those deleted in CopMD3p vector

| SEQ ID NO | Gene | Protein Accession ID | Amino Acid Sequence | Location |
|---|---|---|---|---|
| | | | EIPIHDLIKDVAIFKNKETVYYLKLNNKTIARFTYFN NIDTAITQEHEYVKIALGIVCKLMINNMHSIVGVNH SNTFVNCLLEDNV | |
| SEQ ID NO: 157 | TB18R | AAF34089.1 | MSRRLIYVLNINRESTHKIQENEIYTYFSHCNIDHTST ELDFVVKNYDLNRRHPVTGYTALHCYLYNNYFTN DVLKILLNHGVDVTMKTSSGRMPVYILLTRCCNISH DVVIDMIDKDKNHLLHRDYSNLLLEYIKSRYMLLK EEDIDENIVSTLLDKGIDPNFKQDGYTALHYYYLCL AHVYKPGECRKPITIKKAKRIISLFIQHGANLNALDN CGNTPFHLYLSIEMCNNIHMTKMLLTFNPNFKICNN HGLTPILCYITSDYIQHDILVMLIHHYETNVGEMPID ERRIIVFEFIKTYSTRPADSITYLMNRFKNINIYTRYE GKTLLHVACEYNNTQVIDYLIRINGDINALTDNNKH ATQLIIDNKENSPYTINCLLYILRYIVDKNVIRSLVDQ LPSLPIFDIKSFEKFISYCILLDDTFYDRHVKNRNSKT YRYAFSKYMSFDKYDGIITKCHDETMLLKLSTVLDT TLYAVLRCHNSRKLRRYLTELKKYNNDKSFKIYSNI MNERYLNVYYKDMYVSKVYDKLFPVFTDKNCLLT LLPSEIIYEILYMLTINDLYNISYPPTKV | Inside Deletion |
| SEQ ID NO: 158 | TB19R | AAF34090.1 | MTMKMMVHIYFVSLSLLLLLFHSYAIDIENEITEFFN KMRDTLPAKDSKWLNPACMFGGTMNDIAALGEPF SAKCPPIEDSLLSHRYKDYVVKWERLEKNRRRQVS NKRVKHGDLWIANYTSKFSNRRYLCTVTTKNGDC VQGIVRSHIKKPPSCIPKTYELGTHDKYGIDLYCGIL YAKHYNNITWYKDNKEINIDDIKYSQTGKELIIHNPE LEDSGRYDCYVHYDDVRIKNDIVVSRCKILTVIPSQ DHRFKLILDPKINVTIGEPANITCTAVSTSLLIDDVLI EWENPSGWLIGFDFDVYSVLTSRGGITEATLYFENV TEEYIGNTYKCRGHNYYFEKTLTTTVVLE | Inside Deletion |
| SEQ ID NO: 159 | ORFR | AAF34091.1 | MHVIDVDVRLYMSTFIIIDQSTENTSIDTTVTINIIYL AIMKIIMNIIMMIMIELV | |
| SEQ ID NO: 160 | TB21R | AAF34092.1 | LKNVECVDIDSTITFMKYDPNDDNKRTCSNWVPLT NNYMEYCLVIYLETPICGGKIKLYHPTGNIKSDKDI MFAKTLDFKSTKVLTGRKTIAVLDISVSYNRSMTTI HYNDDVDIDIHTDKNGKELCYCYITIDDHYLVDVET IGVIVNRSGKCLLVNNHLGIGIVKDKRISDSFGDVC MDTIFDFSEARELFSLTNDDNRNIAWDTDKLDDDT DIWTPVTENDYKFLSRLVLYAKSQSDTVFDYYVLT GDTEPPTVFIFKVTRFYFNMPK | |
| SEQ ID NO: 161 | TB22L | AAF34093.1 | MYCRCSHGYTGIRCQHVVLVDYQRSEKPNTTTSYIP SPGIMLVLVGIIIITCCLLSVYRFTRRTKLPLQDMVVP | |
| SEQ ID NO: 162 | TB23R (44% 5') | AAF34094.1 | MHVPASLQQSSSSSSSCTEEENKHHMGIDVIIKVTK QDQTPTNDKICQSVTEITESESDPDPEVESEDDSTSV EDVDPPTTYYSIIGGGLRMNFGFTKCPQIKSISESAD GNTVNARLSSVSPGQGKDSPAITHEEALAMIKDCEV SIDIRCSEEEKDSDIKTHPVLGSNISHKKVSYEDIIGST IVDTKCVKNLEFSVRIGDMCKESSELEVKDGFKYVD GSASEGATDDTSLIDSTKLKACV | Inside Deletion |
| | TB20R ORFL | | | |

TABLE 39

Examples of proteins encoded by Wyeth Vaccinia genes equivalent to those deleted in CopMD3p vector

| SEQ ID NO | Gene | Protein Accession ID | Amino Acid Sequence | Location |
|---|---|---|---|---|
| SEQ ID NO: 163 | VAC_DPP20_207 | AEY74905.1 | MNHCLLAISAVYFKAKWLTPFEKEFTSDYPFYVSPT EMVDVSMMSMYGKAFNHASVKESFGNFSIIELPYV GDTSMMVILPDKIDGLESIEQNLTDTNFKKWCDFM DAMFIDVHIPKFKVTGSYNLVDTLVKSGLTEVFGST GDYSNMCNLDVSVDAMIHKTYIDVNEEYTEAAAA TCALVSDCASTVTNEFCADHPFIYVIRHVDGKILFV GRYCSPTTNC | Inside Deletion |
| SEQ ID NO: 164 | VAC_DPP10_208 | AEY74906.1 | MTANFSTHVFSPQHCGCDRLTSIDDVKQCLTEYIYW SSYAYRNRQCAGQLYSTLLSFRDDAELVFIDIRELV KHMPWDDVKDCAEIIRCYIPDEQKTIREISAIIGLCA YAATYWGGEDHPTSNSLNALFVMLEMLNYVDYNII FRRMN | Inside Deletion |
| SEQ ID NO: 165 | VAC_DPP12_209 | AEY74907.1 | MSILPVIFLSIFFYSSFVQTFNASECIDKGQYFASFME LENEPVILPCPQINTLSSGYNILDILWEKRGADNDRII PIDNGSNMLILNPTQSDSGIYICITTNETYCDMMSLN LTIVSVSESNIDLISYPQIVNERSTGEMVCPNINAFIAS NVNADIIWSGHRRLRNKRLKQRTPGIITIEDVRKND AGYYTCVLEYIYGGKTYNVTRIVKLEVRDKIIPSTM QLPDGIVTSIGSNLTIACRVSLRPPTTDTDVFWISNG MYYEEDDGDGDGRISVANKIYMTDKRRVITSRLNI NPVKEEDATTFTCMAFTIPSISKTVTVSIT | Inside Deletion |
| SEQ ID NO: 166 | VAC_DPP20_210 | AEY4908.1 | MSRKFMQVYEYDREQYLDEFIEDRYNDSFITSPEYY SAEKYMCRYTTLNHNCVNVRRCALDSKLLHDIITN CKIYNNIELVRATKFVYYLDLIKCNWVSKVGDSVL YPVIFITHTSTRNLDKVSVKTYKGVKVKKLNRCAD HAIVINPFVKFKLTLPNKTSHAKVLVTFCKLRTDITQ IEAPLSGNVLVYTFPDINKRIPGYIHVNIEGCIDGMIY INSSKFACVLKLHRSMYRIPPFPIDKSCCSQYTNDDI EIPIHDLIKDVAIFKNKETVYYLKLNNKTIARFTYFN NIDTAITQEHEYVKIALGIVCKLMINNMHSIVGVNH SNTFVNCLLEDNV | Inside Deletion |
| SEQ ID NO: 167 | VAC_DPP20_211 | AEY74909.1 | MSRRLIYVLNINRESTHKIQENEIYTYFSHCNIDHTST ELDFVVKNYDLNRRQPVTGYTALHCYLYNNYFTN DVLKILLNHGVDVTMKTSSGRMPVYILLTRCCNISH DVVIDMIDKDKNHLSHRDYSNLLLEYIKSRYMLLK EEDIDENIVSTLLDKGIDPNFKQDGYTALHYYYLCL AHVYKPGECRKPITIKKAKRIISLFIQHGANLNALDN CGNTPFHLYLSIEMCNNIHMTKMLLTFNPNFKICNN HGLTPILCYITSDYIQHDILVMLIHHYETNVGEMPID ERRIIVFEFIKTYSTRPADSITYLMNRFKNINIYTRYE GKTLLHVACEYNNTHVIDYLIRINGDINALTDNNKH AIQLIIDNKENSPYTIDCLLYILRYIVDKNVIRSLVDQ LPSLPIFDIKSFEKFISYCILLDDTFYNRHVRNRNSKT YRYAFSKYMSFDKYDGIITKCHDETMLLKLSTVLDT TLYAVLRCHNSKKLRRYLNELKKYNNDKSFKIYSNI MNERYLNVYYKDMYVSKVYDKLFPVFTDKNCLLT LLPSEIIYEILYMLTINDLYNISYPPTKV | Inside Deletion |
| SEQ ID NO: 168 | VAC_DPP20_212 | AEY74910.1 | MTMKMMVHIYFVSLSLLLLLFHSYAIDIENEITEFFN KMRDTLPAKDSKWLNPACMFGGTMNDIATLGEPFS AKCPPIEDSLLSHRYKDYVVKWERLEKNRRRQVSN KRVKHGDLWIANYTSKFSNRRYLCTVTTKNGDCV QGIVRSHIRKPPSCIPKTYELGTHDKYGIDLYCGILY AKHYNNITWYKDNKEINIDDIKYSQTGKKLIIHNPEL EDSGRYDCYVHYDDVRIKNDIVVSRCKILTVIPSQD HRFKLKRNCGYASN | Inside Deletion |
| SEQ ID NO: 169 | VAC_DPP10_217 | AEY74911.1 | MRQIKINGTDMLTVMYMLNKPTKKRYVNNPIFTD WANKQYKFYNQIIYNANKLIEQSKKIDDMIEEVSID DNRLSTLPLEIRHLIFSYAFL | Not Present |
| SEQ ID NO: 170 | VAC_DPP10_218 | AEY74912.1 | MSSKGGSGGMWSVFIHGHDGSNKGSKTYTSGGGG MWGGGSSSGVNGGVKSGTGKI | Outside Deletion |
| SEQ ID NO: 171 | VAC_DPP10_219 | AEY74913.1 | MFDYLENEEVALDELKQMLRDRDPNDTRNQFKNN ALHAYLFNEHCNNVEVVKLLLDSGTNPLRKNWRQ LPH | Outside Deletion |

TABLE 39-continued

Examples of proteins encoded by Wyeth Vaccinia genes equivalent to those deleted in CopMD3p vector

| SEQ ID NO | Gene | Protein Accession ID | Amino Acid Sequence | Location |
|---|---|---|---|---|
| SEQ ID NO: 172 | VAC_DPP10_220 | AEY74914.1 | MLKLKDIAMALLEATGFSNINDFNIFSYMKSKNVD VDLIKVLVEHGFDLSVKCENHRSVIENYVMTMILFI ENGCSVLYEDEY | Outside Deletion |
| SEQ ID NO: 173 | VAC_DPP10_221 | AEY74915.1 | MKGIDNTAYSYIDDLTCCTRGIMADYLNSDYRYNK DVDLVKLFLENGKPHGIMCSIVPLWRNDKETIFLILK TMNSDVLQHILIEYMTFGDIPLVEYGTVVNKEAIHG YFRNINIDSYTMKYLLKKEGRCHQLSRLDTYVNPT MDVIISTLIHTKRVFVTCLMLAQFLVL | Outside Deletion |
| SEQ ID NO: 174 | VAC_DPP10_222 | AEY74916.1 | MPSIISIGHLCKSNYGCYNFYTYTYKKGLCDMSYAC PILSTINICLPYLKDINMIDKRGETLLHKAVRYNKQS LVSLLLESGSDVNIRSNNGYTCIAIAINESKNIELLKM LLCHKPTLDYVIDSLREISNIVDNDYAIKQCIKYAMII DDCTSSKIPEFISQRYNDYIDLCN | Outside Deletion |
| SEQ ID NO: 175 | VAC_DPP10_223 | AEY49171.1 | MKKIMVGGNTMFSLIFTDHGAKIIHRYANNPELREY YELKQNKIYVEAYDIISNAIVKHDRIHKTIESVDDNT YISNLPYTIKYKIFEQQ | Outside Deletion |
| SEQ ID NO: 176 | VAC_DPP10_224 | AEY74918.1 | MRILFLIAFMYGCVHSYVNAVETKCSNLDIVTSSGE FHCSGCVEHMPNFSYMYWLAKDMRSDEDAKFIEH LGEGIKEDETVRTIDGRIVTLQKVLHVTDTNKFAHY RFTCVLTTIDGVSKKNIWLK | Outside Deletion |
| SEQ ID NO: 177 | VAC_DPP10_225 | AEY74919.1 | MKLFTQNDRYFGLLDSCNHIFCITCINIWFIKTRRET GASDNCPICRTRFRNITMSKFYKLVN | Outside Deletion |
| SEQ ID NO: 178 | VAC_DPP10_226 | AEY74920.1 | MHYPKYYINITKINPHLANQFRAWKKRIAGRDYMT NLSKDTGIQQSKLYVTVKKIETYMVYIYTTI | Outside Deletion |
| SEQ ID NO: 179 | VAC_DPP20_227 | AEY74921.1 | MDIYDDKGLQTIKLFNNEFDCIRNDIRELFKHVTDS DSIQLPMEDNSDIIENIRKILYRRLKNVECVDIDNTIT FMKYDPNDDNKRTCSNWVPLTNNYMEYCLVIYLE TPICGGKIKLYHPTGNIKSDKDIMFAKTLDFKSKKVL TGRKTIAVLDISVSYNRSITTIHYNDDVDIDIHTDKN GKELCYCYITIDDHYLVDVETIGVIVNRSGKCLLVN NHLGIGIVKDKRISDSFGDVCMDTIFDFSEARELFSL TNDDNRNIAWDTDKLDDDTDIWTPVTENDYKFLSR LVLYAKSQSDTVFDYYVLTGDTEPPTVFIFKVTRFY FNMFK | Outside Deletion |
| SEQ ID NO: 180 | VAC_DPP20_228 | AEY74922.1 | MLINYLMLLFAAMIIRSFADSGNAIETTLPEITNATT DIPAIRLCGPEGDGYCLHGDCIHARDIDGMYCRCSH GYTGIRCQHVVLVDYQRSEKPNITTSYIPSPGIMLV LVGIIIITCCLLSVYRFTRRTNKLPLQDMVVP | Outside Deletion |
| SEQ ID NO: 181 | VAC_DPP20_229 | AEY74923.1 | MDIFKELIVKHPDENVLISPVSILSTLSILNHGAAGST AEQLSKYIENMNENTPDDKKDDNNDMDVDIPYCAT LATANKIYGSDSIEFHASFLQKIKDDFQTVNFNNAN QTKELINEWVKTMTNGKINSLLTSPLSINTRMTVVS AVHFKAMWKYPFSKHLTYTDKFYISKNIVTSVDMM VGTENNLQYVHINELFGGFSIIDIPYEGNSSMVIILPD DIEGIYNIEKNITDEKFKKWCGMLSTKSIDLYMPKF KVEMTEPYNLVPILENLGLTNIFGYYADFSKMCNET ITVEKFLHTTFIDVNEEYTEASAVTGVFMTNFAMVY RTKVYINHPFMYMIKDTTGRILFIGKYCYPQ | Outside Deletion |
| SEQ ID NO: 182 | C13L/ VAC_DPP20_230 | AEY74924.1 | MMIYGLIACLIFVTSSIASPLYIPVIPPITEDKSFNSVE VLVSLFRDDQKDYTVISQFNNYTIDTKDWTIGVLST PDGLDIPLTNITYWSRFTIGRALFKSESEDIFQKKMSI LGVSIECKKSSTLLTFLTVRKMTRVFNKFPDMAYYR GDCLKAVYVTMTYKNTKTGETDYTYLSNGGLPAY YRNGVDG | Outside Deletion |
| SEQ ID NO: 183 | VAC_DPP20_231 | AEY74925.1 | MNLQKLSLAIYLTATCSWCYETCIRKTALYHDIQLE HVEDNKDSVASLPYK | Outside Deletion |
| SEQ ID NO: 184 | VAC_DPP20_232 | AEY74926.1 | MSLESFIITTFNNSSTNIDNMCHLYVKVCPSSLLFR LFVECCDINKLVEGTTPLHCYLMNEGFESSVLKNLL KEYVMTSITQIFNS | Inside Deletion |

TABLE 39-continued

Examples of proteins encoded by Wyeth Vaccinia genes equivalent to those deleted in CopMD3p vector

| SEQ ID NO | Gene | Protein Accession ID | Amino Acid Sequence | Location |
|---|---|---|---|---|
| SEQ ID NO: 185 | VAC_DPP20_233 | AEY74927.1 | MISLSFLIHNPLKKWKLKPSISINGYRSTFTMAFPCA QFRPCHCHATKDSLNTVADVRHCLTEYILWVSHRW THRETAGPLYRLLISFRTDATELFGGELKDSLPWDNI DNCVEIIKCFIRNDSMKTAEELRAIIGLCTQSAIVSGR VFNDKYIDILLMLRKILNENDYLTLLDHIRTAKY | Inside Deletion |
| SEQ ID NO: 186 | VAC_DPP20_234 | AEY74928.1 | MIAFIIFREIGIISTRIAMDCTCILCRLLDEDVTYKKIK LEIETCHNLSKHIDRRGNNALHCYVFNKCDTDIKIV RLLLSRGVERLCRNNEGLTPLGVYSKHRYVKSQIVH LLISSYSNSSNELKSNINDFDLSSDNIDLRLLKYLIVD KRIRPSKNTNYAINSLGLVDIYVTTPNPRPEVLLWLL KSECYSTGYVFRTCMYNSDMCKNSLHYYISSHRES QSLSKDVIKCLINNNVSIHGRDEGGSLPIQYYWSFST IDIEIVKLLLIKDVDTCRVYDVSPILEAYYLNKRFRV TPYNVDMEIVNLLIERRHTLVDVMRSITSYDSREYN HYIIDNILKRFRQQDESIVQAMLINYLHYGDMVVRC MLDNGQQLSSARLLC | Inside Deletion |
| SEQ ID NO: 187 | VAC_DPP20_235 | AEY74929.1 | MYGLILSRFNNCGYHCYETILIDVFDILSKYMDNID MIDNENKTLLYYAVDVNNIQFAKRLLEYGASVTTS RSIINTAIQKSSYRRENKTKLVDLLLSYHPTLETMID AFNRDIRYLYPEPLFACIRYALILDDDFPSKVKYDIS GRHKELKRYRVDINRMKNAYISGVSMFDILFKRSK RHRLRYAKNPTSNGTKKN | Inside Deletion |
| SEQ ID NO: 188 | VAC_DPP20_236 | AEY74930.1 | MSRINITKKIYCSVFLFLFLSYISNYEKVNDEMYEMG EMDEIVSIVRDSMWYIPNVFMDDGKNEGHVSVNNV CHMYFTFFDVDTSSHLFKLVIKHCDLNKRGNSPLHC YTMNTRFNPSVLKILLHHGMRNFDSKDDHYQSITRS LIY | Inside Deletion |
| SEQ ID NO: 189 | VAC_DPP20_237 | AEY74931.1 | MEQTLTRLHTYLQQYTKHSPRVVYALLSRGYVIILI VHPSWNDCATGHILIMLLNWHEQKEEGQHLLYLFI KHNQGYTLNILRYLLDRFDIQKDEYYNTAFQNCNN NVASYIGYDINLPTKDGIRLGV | Inside Deletion |
| SEQ ID NO: 190 | VAC_DPP20_238 | AEY74932.1 | MLPHTSDTTSTFRLKTVFDLVFENRNIIYKADVVNDI IHHRLKVPMIKSLFYKMSEFSPYDDYYVKKILAYCL LRDESFAELHSKFCLNEDYKSVFMKNISFDKIDSIIVT | Inside Deletion |
| SEQ ID NO: 191 | VAC_DPP20_239 | AEY74933.1 | MHHPMESVKTTNTNAIICVREHTLPDYANTQCTPC GSGTFTSRNNHLPACLSCNGRRDRVTLLTIESVNAL PDIIVFSKDHPDARHVFPKQNVE | Inside Deletion |
| SEQ ID NO: 192 | VAC_DPP20-241 (43% 5') | AEY74934.1 | MHVPASLQQSSSSCTEEENKHHMGIDVIIKVTKQDQ TPTNDKKQSVTEITESESDPDPEVESEDDSTSVEDV DLPTTYYSIIGGGLRMNFGFTKCPQIKSISESADGNT VNARLSSVSPGQGKDSPAITHEEALAMIKDCEVSIDI RCSEEEKDSDIKTHPVLGSNISHKKVSYEDIIGSTIVD TKCVKNLEFSVRIGDMCKESSELEVKDGFKYVDGS ASEGATDDTSLIDSTKLKACV | Inside Deletion |
| SEQ ID NO: 193 | VAC_DPP10_225 | AEY74919.1 | MKLFTQNDRYFGLLDSCNHIFCITCINIWHKTRRET GASDNCPICRTRFRNITMSKFYKLVN | Outside Deletion |
| SEQ ID NO: 194 | VAC_DPP10_226 | AEY74920.1 | MHYPKYYINITKINPHLANQFRAWKKRIAGRDYMT NLSKDTGIQQSKLYVTVKKIETYMVYIYTTI | Outside Deletion |
| SEQ ID NO: 195 | VAC_DPP20_207 | AEY74921.1 | MDIYDDKGLQTIKLFNNEFDCIRNDIRELFKHVTDS DSIQLPMEDNSDIIENIRKILYRRLKNVECVDIDNTIT FMKYDPNDDNKRTCSNWVPLTNNYMEYCLVIYLE TPICGGKIKLYHPTGNIKSDKDIMFAKTLDFKSKKVL TGRKTIAVLDISVSYNRSITTIHYNDDVDIDIHTDKN GKELCYCYITIDDHYLVDVETIGVIVNRSGKCLLVN NHLGIGIVKDKRISDSFGDVCMDTIFDFSEARELFSL TNDDNRNIAWDTDKLDDDTDIWTPVTENDYKFLSR LVLYAKSQSDTVFDYYVLTGDTEPPTVFIFKVTRFY FNMPK | Outside Deletion |
| SEQ ID NO: 196 | VAC_DPP20:228 | AEY74922.1 | MLINYLMLLFAAMIIRSFADSGNAIETTLPEITNATT DIPAIRLCGPEGDGYCLHGDCIHARDIDGMYCRCSH GYTGIRCQHVVLVDYQRSEKPNTTTSYIPSPGIMLV LVGIIIITCCLLSVYRFTRRTNKLPLQDMVVP | Outside Deletion |

TABLE 39-continued

Examples of proteins encoded by Wyeth Vaccinia genes equivalent to those deleted in CopMD3p vector

| SEQ ID NO | Gene | Protein Accession ID | Amino Acid Sequence | Location |
|---|---|---|---|---|
| SEQ ID NO: 197 | VAC_DPP20_239 | AEY74933.1 | MHHPMESVKTTNTNAIICVREHTLPDYANTQCTPC GSGTFTSRNNHLPACLSCNGRRDRVTLLTIESVNAL PDIIVFSKDHPDARHVFPKQNVE | Inside Deletion |
| SEQ ID NO: 198 | VAC_DPP20-241 (43% 5') | AEY74934.1 | MHVPASLQQSSSSCTEEENKHHMGIDVIIKVTKQDQ TPTNDKICQSVTEITESESDPDPEVESEDDSTSVEDV DLPTTYYSIIGGGLRMNFGFTKCPQIKSISESADGNT VNARLSSVSPGQGKDSPAITHEEALAMIKDCEVSIDI RCSEEEKDSDIKTHPVLGSNISHKKVSYEDIIGSTIVD TKCVKNLEFSVRIGDMCKESSELEVKDGFKYVDGS ASEGATDDTSLIDSTKLKACV | Inside Deletion |

TABLE 40

Examples of proteins encoded by Lister Vaccinia genes equivalent to those deleted in CopMD3p vector

| SEQ ID NO | Gene | Protein Accession ID | Amino Acid Sequence | Location |
|---|---|---|---|---|
| SEQ ID NO: 200 | B15R/ List191 | ABD52695.1 | MTANFSTHVFSPQHCGCDRLTSIDDVKQCLTEYIYW SSYAYRNRQCAGQLYSTLLSFRDDAELVFIDIRELV KNMPWDDVKDCTEIIRCYIPDEQKTIREISAIIGLCA YAATYWGGEDHPTSNSLNALFVMLEMLNYVDYNII FRRMN | Inside Deletion |
| SEQ ID NO: 201 | List192 | ABD52696.1 | MSILPVIFLPIFFYSSFVQTFNAPECIDKGQYFASFME LENEPVILPCPQINTLSSGYNILDILWEKRGADNDRII PIDNGSNMLILNPTQSDSGIYICITTNETYCDMMSLN LTIVSVSESNIDLISYPQIVNERSTGEMVCPNINAFIAS NVNADIIWSGHRRLRNKRLKQRTPGIITIEDVRKND AGYYTCVLEYIYRGKTYNVTRIVKLEVRDKIIPSTM QLPDGIVTSIGSNLTIACRVSLRPPTTDADVFWISNG MYYEEDDGDGNGRISVANKIYMTDKRRVITSRLNI NPVKEEDATTFTCMAFTIPSISKTVTVSIT | Inside Deletion |
| SEQ ID NO: 202 | B17L/ List193 | ABD52698.1 | MSRKFMQVYEYDREQYLDEFIEDRYNDSFITSPEYY SAEKYMCRYTTLNHNCINVRRCALDSKLLHDIITNC KIYNNIELVRATKFVYYLDLIKCNWVSKVGDSVLYP VIFITHTSTRNLDKVSVKTYKGVKVKKLNRCADHAI VINPFVKFKLTLPNKTSHAKVLVTFCKLRTDITQIEA PLSGNVLVYTFPDINKRIPGYIHVNIEGCIDGMIYINS SKFACVLKLHRSMYRIPPFPIDKSCCSQYTNDDIEIPI HDLIKDVAIFKNKETVYYLKLNNKTIARFTYFNNID TAITQEHEYVKIALGIVCKLMINNMHSIVGVNHSNT FVNCLLEDNV | Inside Deletion |
| SEQ ID NO: 203 | crmE/ List195 | ABD52700.1 | MTKVIIILGFLIINTNSLSMKCEQGVSYYNSQELKCC KLCKPGTYSDHRCDKYSDTICGHCPSDTFTSIYNRSP WCHSCRGPCGTNRVEVTPCTPTTNRICHCDSNSYCL LKASDGNCVTCAPKTKCGRGYGKKGEDEMGNTIC KKCRKGTYSDIVSDSDQCKPMTR | Not Present |
| SEQ ID NO: 204 | L6/ List196 | ABD52701.1 | MAMPSLSACSSIEDDFNYGSSVASASVHIRMAFLRK VYGILCLQFLLTTATTAVFLYFDCMRTFIQGSPVLIL ASMFGSIGLIFALTLHRHKHPLNLYLLCGFTLSESLT LASVVTFYDVHVVMQAFMLTTAAFLALTTYTLQSK RDFSKLGAGLFAALWILILSGLLGIFVQNETVKLVLS AFGALVFCGFIIYDTHSLIHKLSPEEYVLASINLYLDII NLFLHLLQLLEVSNKK | Not Present |
| SEQ ID NO: 205 | List197 | ABD52704.1 | MASPCAKFRPCHCHATKDSLNTVADVRHCLTEYIL WVSHRWTHRESAGSLYRLLISFRTDATELFGGELKD SLPWDNCVEIIKCFIRNDSMKTAEELRAIIGLCTQSAI VSGRVFNDKYIDILLMLRKILNENDYLTLLDHIRTA KY | Inside Deletion |

TABLE 40 -continued

Examples of proteins encoded by Lister Vaccinia genes equivalent to those deleted in CopMD3p vector

| SEQ ID NO | Gene | Protein Accession ID | Amino Acid Sequence | Location |
|---|---|---|---|---|
| SEQ ID NO: 206 | List199C | ABD52706.I | MEQTLTRLHTYLQQYTKHSPRVVYALLSRGYVIILI VHPSWNDCATGHILIMLLNWHEQKEEGQHLLYLFI KHNQGYTLNILRYLLDRFDIQKDEYYNTAFQNCNN NVASYIGYDINLPTKDGIRLGV | Inside Deletion |
| SEQ ID NO: 207 | List199D | ABL63830.1 | MLPHTSDTTSTFRLKTVFDLVFENRNIIYKADVVNDI IHHRLKVSLPMIKSLFYKMSLPTTITT | Inside Deletion |
| SEQ ID NO: 208 | C23L/ List201 (47% 5') | ABL63827.1 | MKQYIVLACMCLAAAAMPASLQQSSSSSSSCTEEE NKHHMGIDVIIKVTKQDQTPTNDKICQSVTEITESES DPDPEVESEDDSTSVEDVDPPTTYYSIIGGGLRMNF GFTKCPQIKSISESADGNTVNARLSSVSPGQGKDSPA ITHEEALAMIKDCEVSIDIRCSEEEKDSDIKTHPVLGS NISHKKVSYEDIIGSTIVDTKCVKNLEFSVRIGDMCK ESSELEVKDGFKYVDGSASEGATDDTSLIDSTKLKA CV | Inside Deletion |
| | List198A List198B List199A List199B List200 List194 | | | |

EXAMPLES

The following examples are put forth so as to provide those of ordinary skill in the art with a description of how the compositions and methods claimed herein are performed, made, and evaluated, and are intended to be purely exemplary of the invention and are not intended to limit the scope of what the inventor regards as her invention.

Example 1—Creation Of the CopMDp3p "SKV-B8R+" Recombinant Orthopoxvirus

The open reading frames (ORFs) from 59 poxvirus strains were clustered into orthologs and aligned at the amino acid level (see FIG. 1 for phylogenetic analysis). Bayesian analysis was performed to determine relatedness of all strains. Poxviruses are very diverse in gene content and host range. There are several naturally occurring Vaccinia wild-type strains, which are different from one another.

Figure 2:
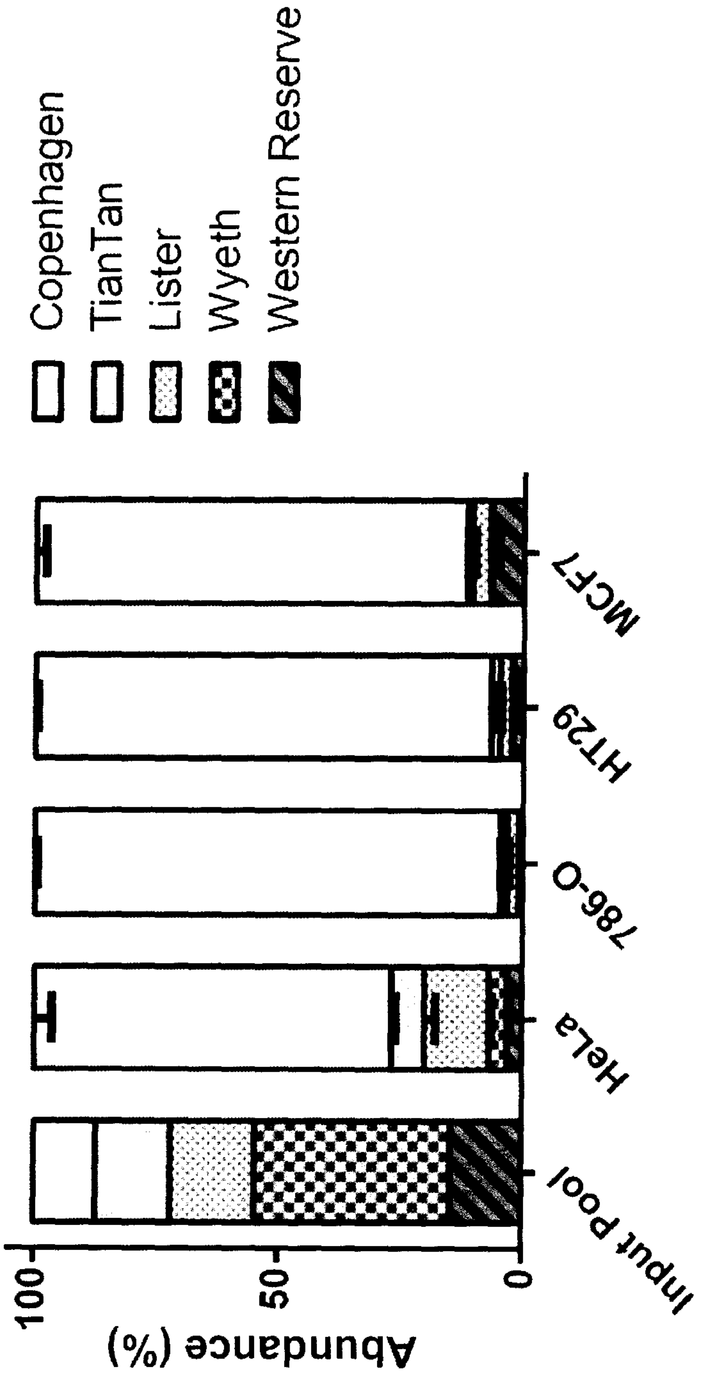
FIG. 2 shows the abundance of different viral strains after passaging 5 Vaccinia viruses in different tumor types.

Five Vaccinia wild type strains (Copenhagen, TianTan, Lister, Wyeth, and Western Reserve) were mixed at equal plaque forming unit counts and sequenced with NGS (Input pool). The resulting mixture was passaged three times in different cancer cell lines (HeLa, 786-O, HT29, MCF7). The final population was sequenced with NGS illumina sequencing. Reads (short DNA fragments) were assigned to various strains based on sequence identity and used to calculate the percent of each strain in the final population. The relative abundance of the different viral strains was then quantified. As shown in FIG. 2, the Copenhagen strain was the most abundant vaccinia strain after three passages in any of the four cancer cell lines indicating that this strain was able to outgrow other strains and therefore replicates faster.

Figure 3:
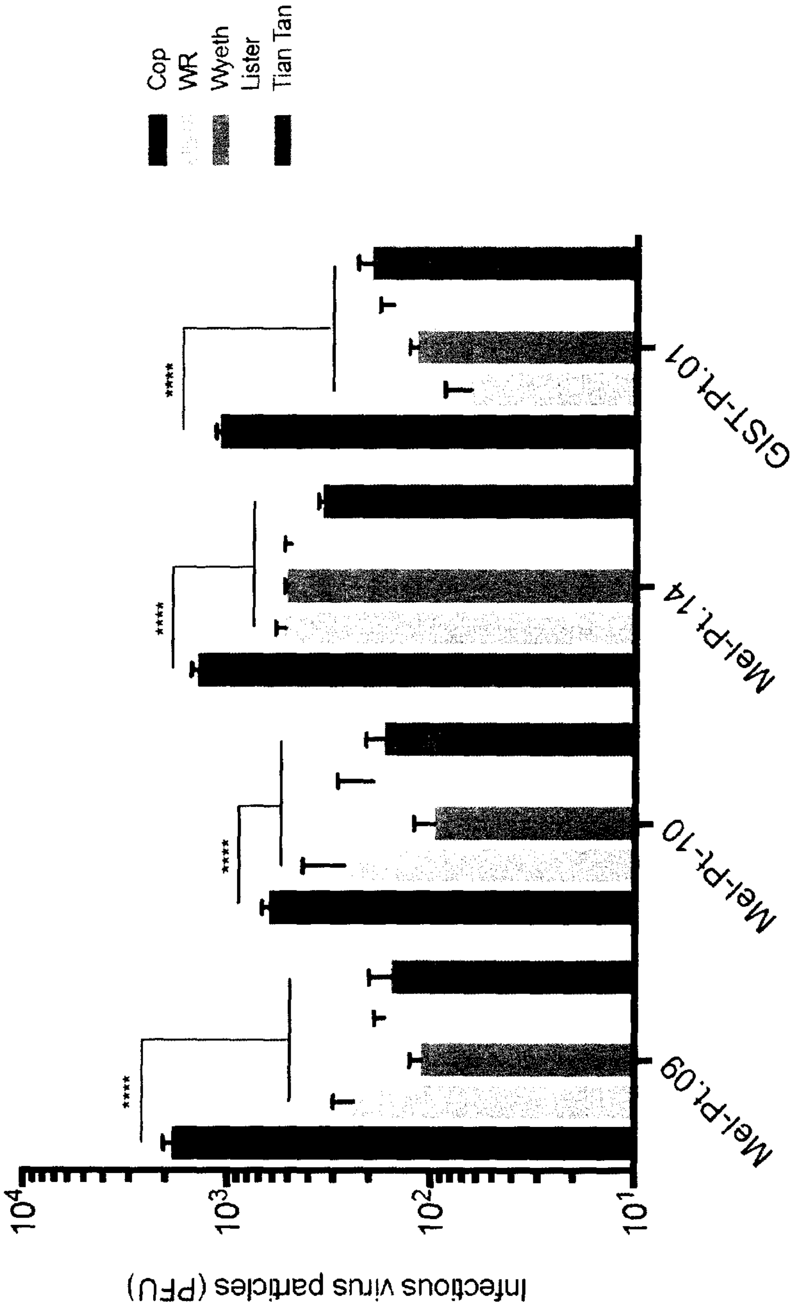
FIG. 3 shows the ability to replicate in various different patient tumor cores of Vaccinia wild-type strains.

Different Vaccinia wild type strains were also used to infect at low PFU ($1\times10^4$) various patient tumor cores. Each strain infected on average 4 replicates each containing three 2×2 mm tumor cores. Replication was assessed through virus titering and is expressed as plaque forming units (PFU) as shown in FIG. 3. The Copenhagen strain grows to higher titers than other strains and therefore replicates faster in patient ex-vivo samples. Patient ex-vivo cores are a good mimic of a patient's 3D tumor.

Figure 4:
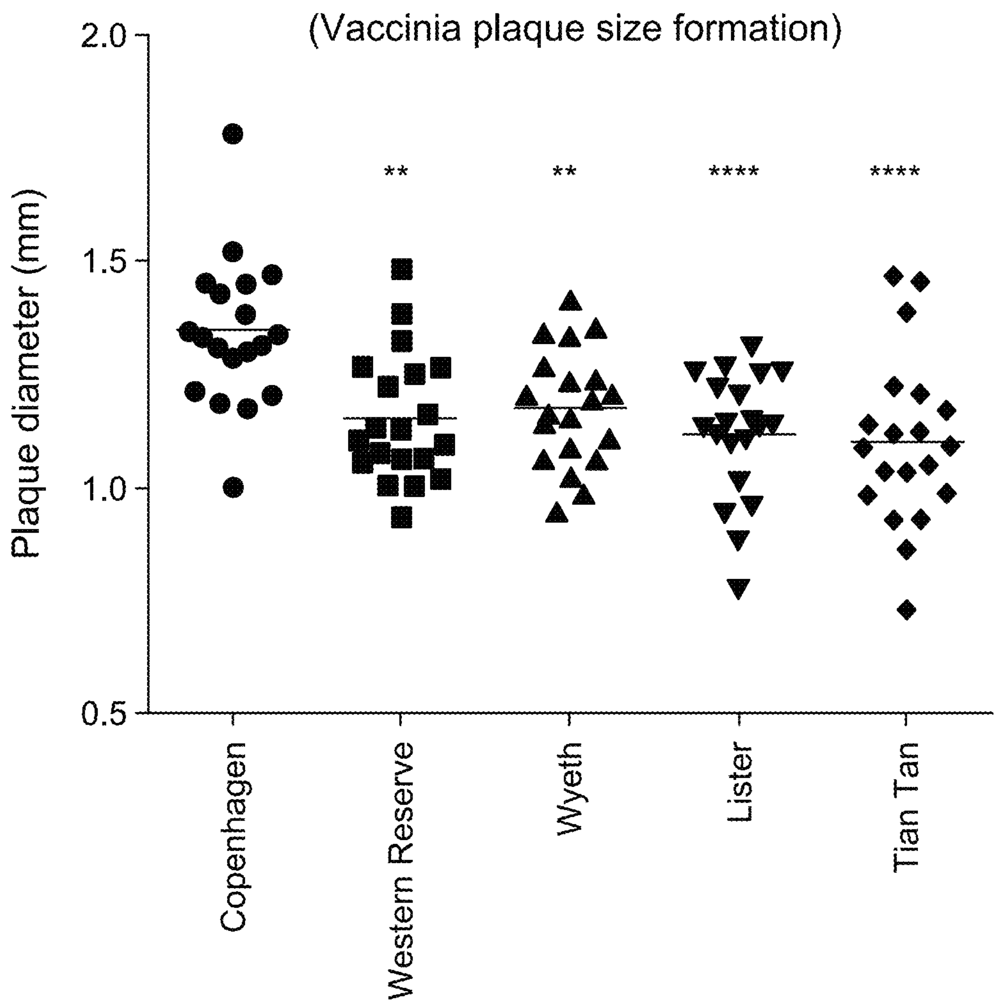
FIG. 4 shows plaque size measurements of different Vaccinia wild-type strains.

Vaccinia wild-type strains were then subjected to a plaque assay on U2-OS cells with a 3% CMC overlay. Two days past infection, 20-30 plaques for each strain were measured for their size. Plaque size measurements for Copenhagen, Western Reserve, Wyeth, Lister, and Tian Tan are shown in FIG. 4. Plaque formation is affected by the ability of the virus to replicate, spread, and kill. The larger plaque sizes observed for the Copenhagen strain suggest that this strain is superior in these abilities, which are important for the development of an oncolytic virus.

Figures 5, 5A, 5B, 5C:
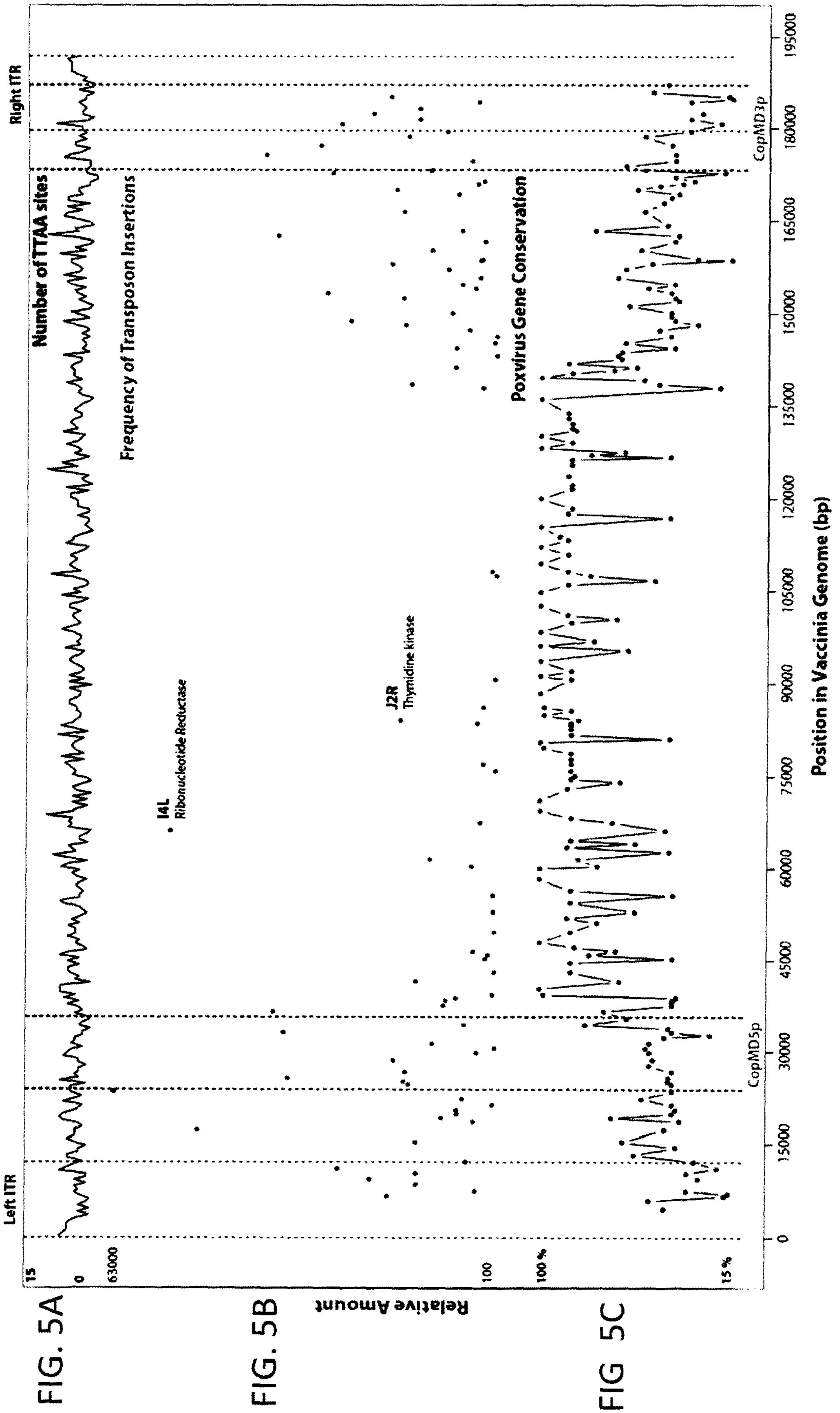
FIG. 5A shows the number of TTAA sites across 1 kb regions in Vaccinia Copenhagen genome.
FIG. 5B shows the frequency of Transposon Insertions across Vaccinia Copenhagen genome. Each dot represents a transposon knockout of a particular gene. The position of the dot on the y-axis is determined by the frequency of the knockout.
FIG. 5C shows Poxvirus gene conservation in 59 viruses. Higher conservation indicates the gene is present in a larger amount of species.
Figure 6:
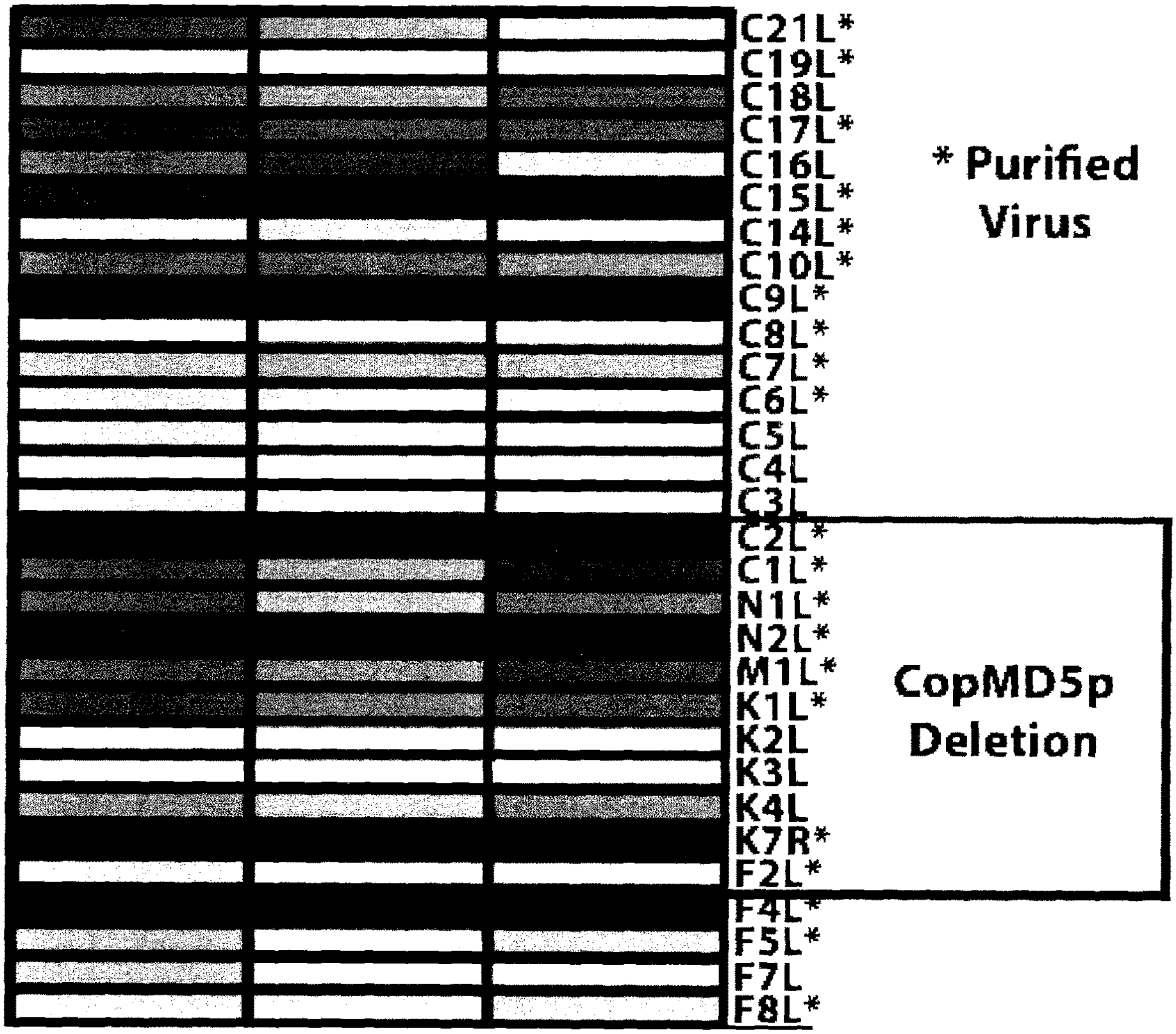
FIG. 6 shows the frequency of various transposon knockouts after passaging in permissive cancer cells.
Figure 6:
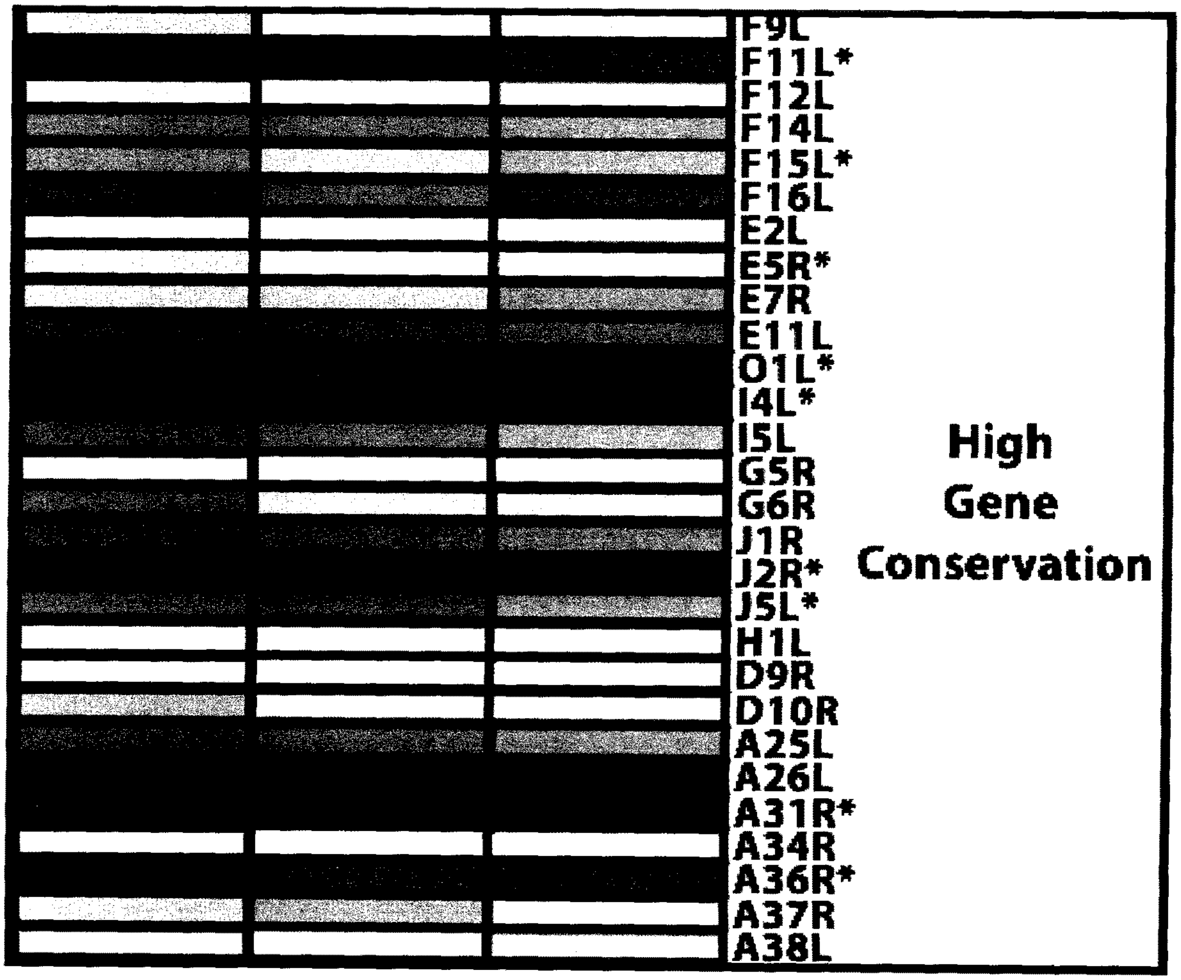
Figure 6:
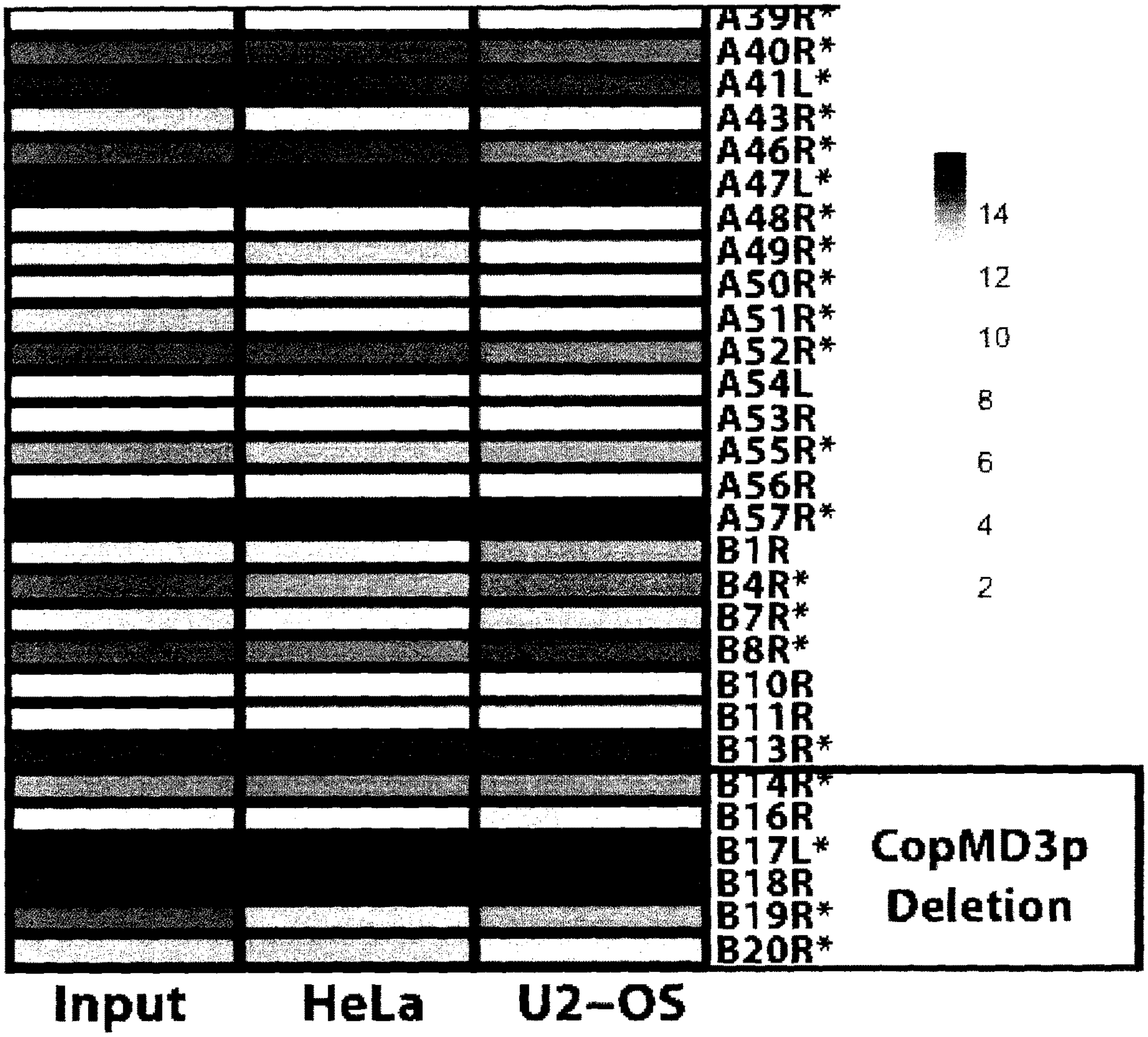
Figure 7:
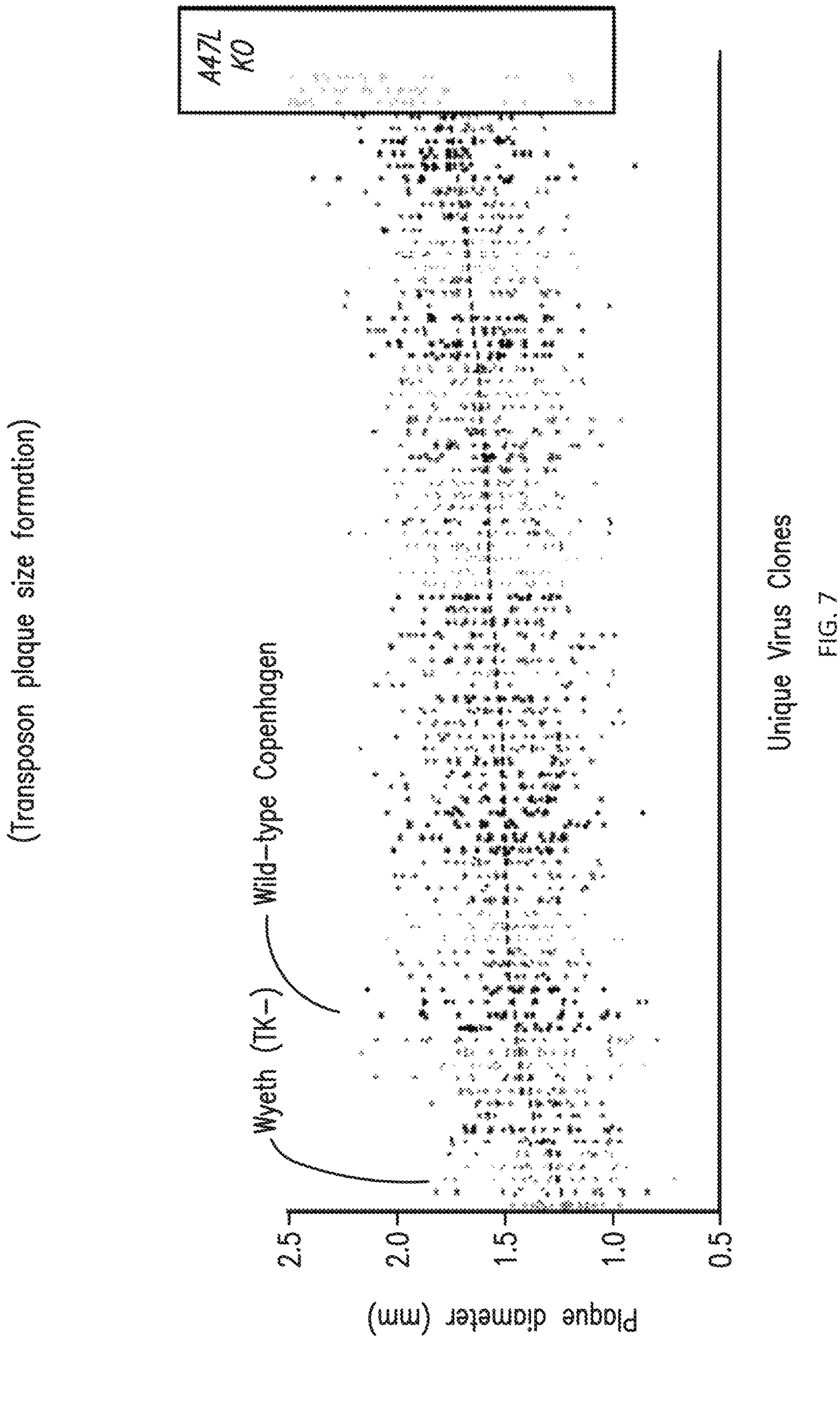
FIG. 7 shows plaque size measurements of purified transposons.

Then, the number of TTAA sites across 1 kb regions in Vaccinia Copenhagen genome were counted (see FIG. 5A). llumina NGS sequencing was combined and used to identify Transposon Insertion Sites (Tn-Seq). The input library was passaged three times in either HeLa or U2-OS cells after which frequencies of transposon knockouts were determined. The frequency of a knockout directly corresponds to the amount of reads supporting the event (see FIG. 5B and FIG. 6).

Finally, all 59 poxvirus genomes from FIG. 1 were used to find ORFs and clustered into orthologous groups. Groups containing Copenhagen genes were plotted based on location of the gene in the Copenhagen genome (x-axis) and size of the group (y-axis). When all 59 species share the same gene the conservation is considered to be 100%. The TTAA motif is required for a transposon insertion and this motif is ubiquitous along the genome, meaning transposons can insert anywhere in the genome. However, it was noted that transposons insert preferentially in areas of low poxvirus gene conservation. While sequencing transposon knockouts, major deletions were identified and labelled as CopMD5p and CopMD3p (see FIG. 5C and FIG. 6). Genes that are present in the middle of the genome and that have an elevated gene conservation (FIG. 5C) are important for viral replication. This is because knocking these genes out with transposon insertions causes a decrease in fitness (less frequency after passaging). Genes that are part of the major deletions CopMD5p and CopMD3p were found to be less important for viral replication as their deletion does not impact fitness.

Figure 8:
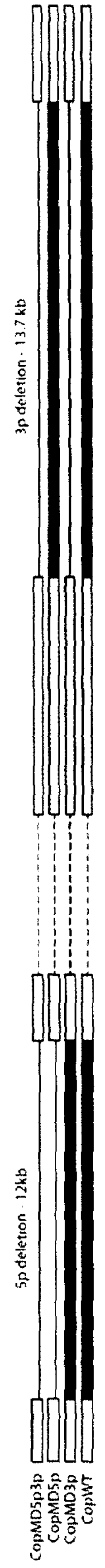
FIG. 8 shows the genomic structure of a 5p deletion (CopMD5p) and a 3p deletion (CopMD3p). CopMD5p and CopMD3p were crossed to generate CopMD5p3p.

Illumina NGS deep sequencing revealed presence of major deletions during the plaque purification process. CopMD5p and CopMD3p represent clones, which were plaque purified and found to harbor major genomic deletions. These 2 clones were used to co-infect a monolayer of HeLa cells at a high MOI (MOI 10) to induce recombination. Random plaque picking and PCR revealed presence of a double deleted CopMD5p3p which contained both genome deletions (see FIG. 8). These 2 deletions were combined and purified to give a replicating virus, referred to herein as "CopMD5p3p", that exhibits deletions in the C2L, C1L, N1L, N2L, M1L, M2L, K1L, K2L, K3L, K4L, K5L, K6L, K7R, F1L, F2L, F3L, B14R, B15R, B16R, B17L, B18R, B19R, and B20R genes, as well as single deletions in each of the ITR genes B21R, B22R, B23R, B24R, B25R, B26R, B27R, B28R, and B29R. As used herein, "CopWT" refers to wild-type Copenhagen vaccinia virus, "CopMD5p" refers to a Copenhagen vaccinia virus harboring deletions in representative 5' genes (C2L, C1L, N1L, N2L, M1L, M2L, K1L, K2L, K3L, K4L, K5L, K6L, K7R, F1L, F2L, F3L), and "CopMD3p" refers to a Copenhagen vaccinia virus harboring deletions in representative 3' genes (B14R, B15R, B16R, B17L, B18R, B19R, and B20R) as well as single deletions in each of the ITR genes B21R, B22R, B23R, B24R, B25R, B26R, B27R, B28R, and B29R.

Figure 35:
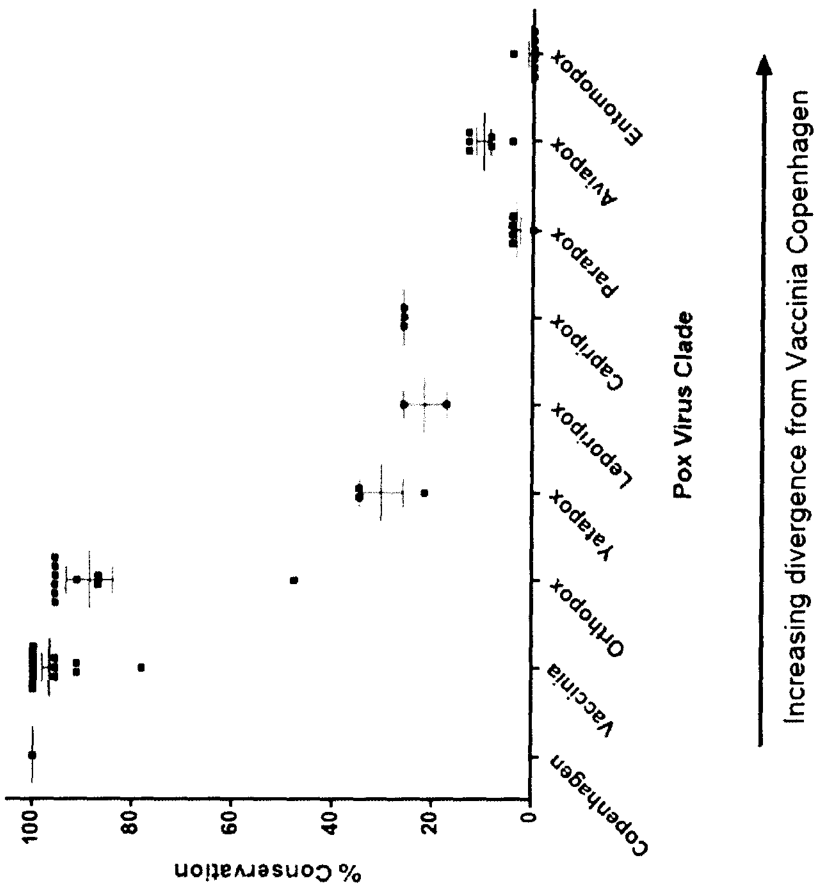
FIG. 35 shows the percentage of genes deleted in CopMD5p3p in various poxvirus genomes.

The 59 poxvirus genomes were then assessed for the presence of these 32 genes deleted in the CopMD5p3p. Homology searches were used to query poxviruses from other clades with amino acid sequences of Table 2 genes from the Copenhagen genome. As shown in FIG. 35, the percentage of these 32 genes present in various poxvirus strains decreases with increasing divergence from the Copenhagen strain (each dot on the plot represents one poxvirus genome). However, a majority of the members of the orthopox family, comprise at least 85% of the the genes which are deleted in the CopMD5p3p recombinant vector.

Example 2—Cancer Cell Death

Figure 9:
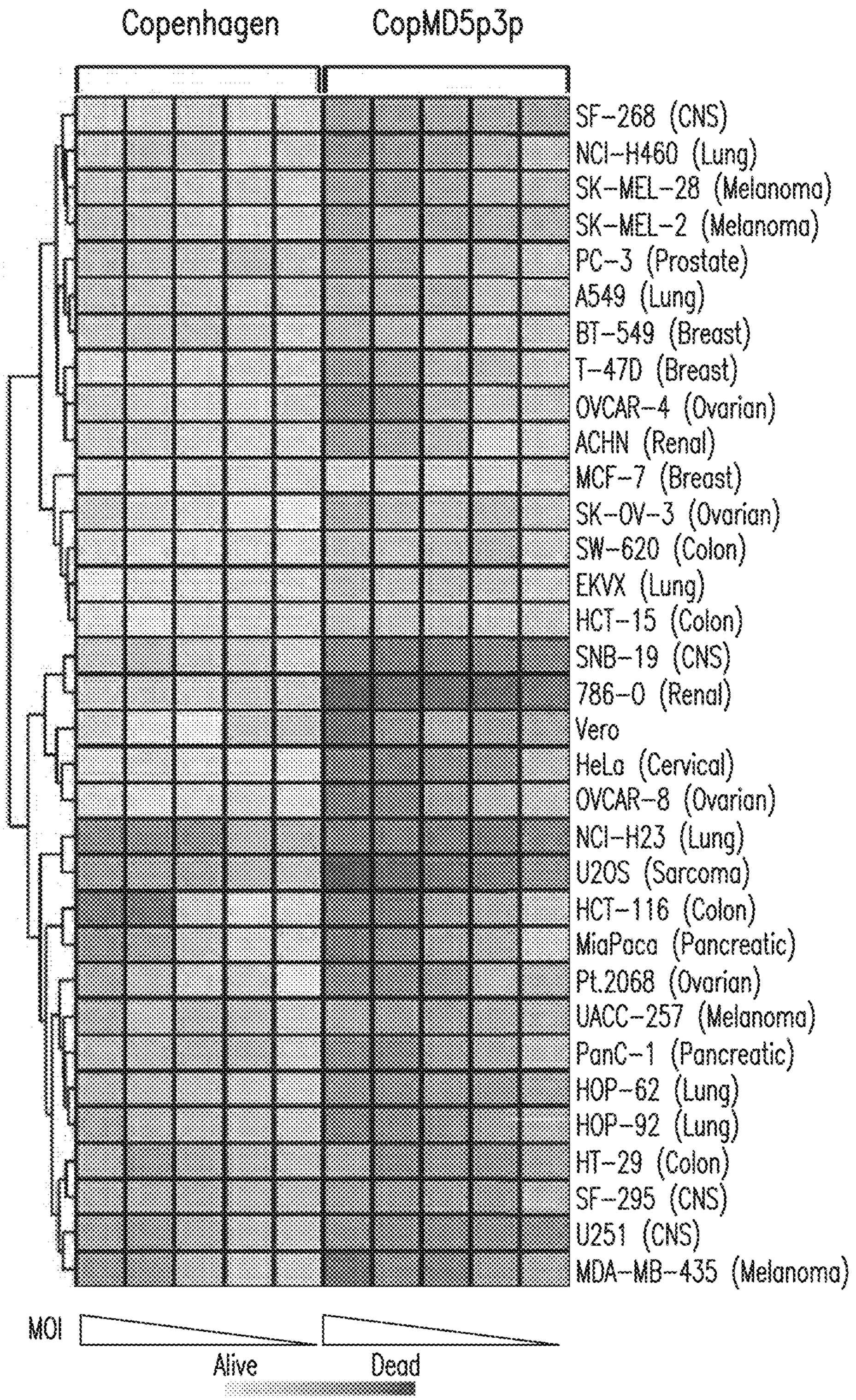
FIG. 9 shows a heatmap showing cancer cell death following infection with either Copenhagen or CopMD5p3p at various doses.

Cancer cells were infected with CopMD5p3p at a range of MOIs (1 to 0.01) in 24-well plates in 4 replicates. Two days post infection with virus, plates were stained with crystal violet. Crystal violet stain was dissolved into SDS and read by spectrophotometry. Data is represented as percent of non-infected cells (see FIG. 9). This data shows that the majority of cancer cell lines die faster when exposed to the CopMD5p3p virus.

The ability of wild-type Copenhagen vaccinia virus and several modified Copenhagen vaccinia virions to induce an anti-tumor immune response and to propagate in various cancer cell lines is also shown in FIGS. 26, 27, and 29-34.

Example 3—Growth in Cancer Cells

Figure 10:
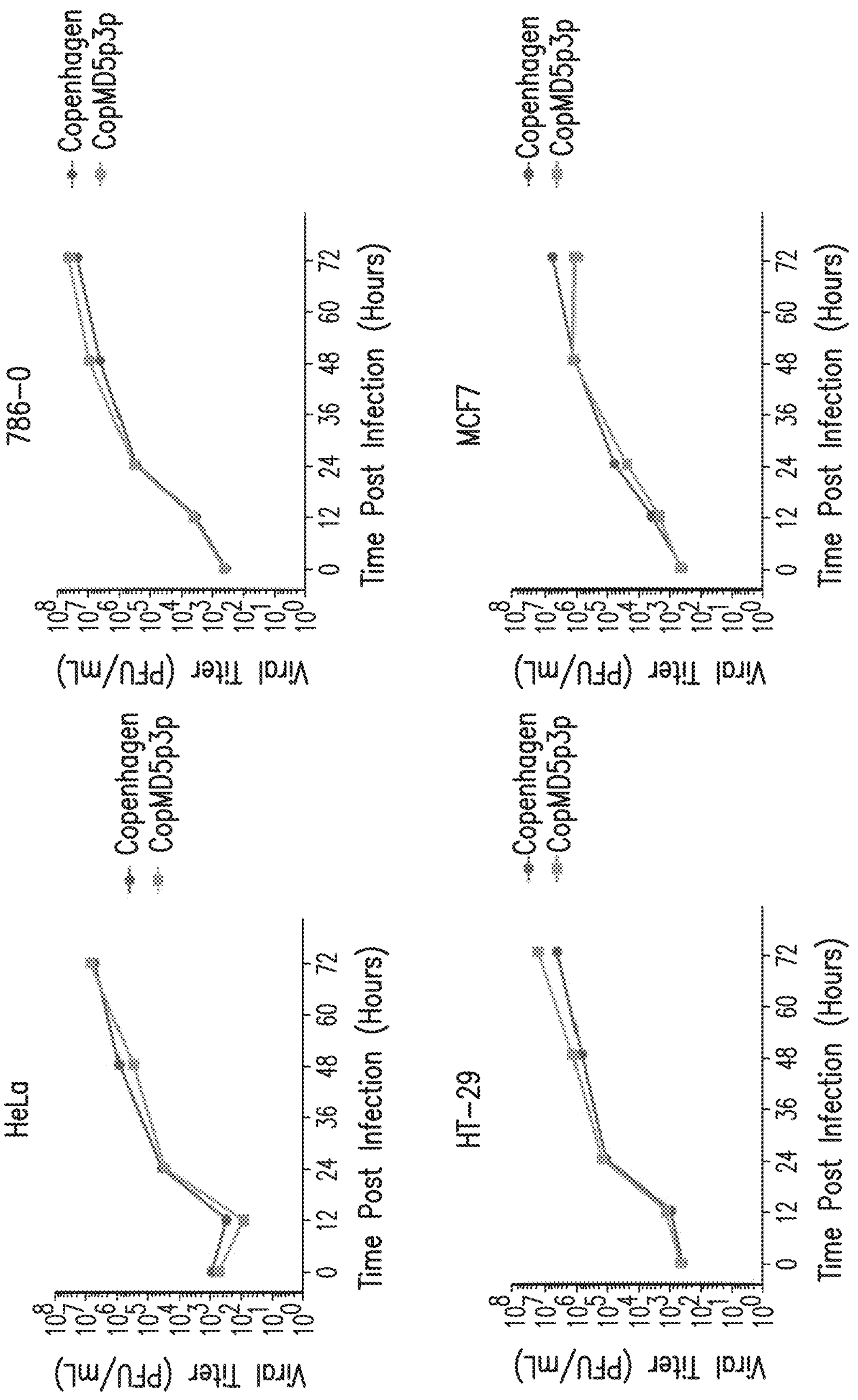
FIG. 10 shows the growth curves of Copenhagen and CopMD5p3p replication in 4 different cancer cell lines.

Four cancer cell lines were infected with CopMD5p3p at a low MOI (0.001) in 24-well plates in triplicates, and at different time points, the virus was collected and tittered. Time 0 h represents input. The growth curves of HeLa, 786-O, HT-29, and MCF7 are shown in FIG. 10. This data shows that the modified CopMD5p3p virus is not impaired in its ability to grow in vitro. This means that the virus is replication competent, even in presence of interferon response. The ability to replicate in mammalian cell lines provides another important advantage. As such, viruses may be manufactured with enhanced speed and efficiency.

Example 4—Growth in Patient Tumor Samples

Figure 11:
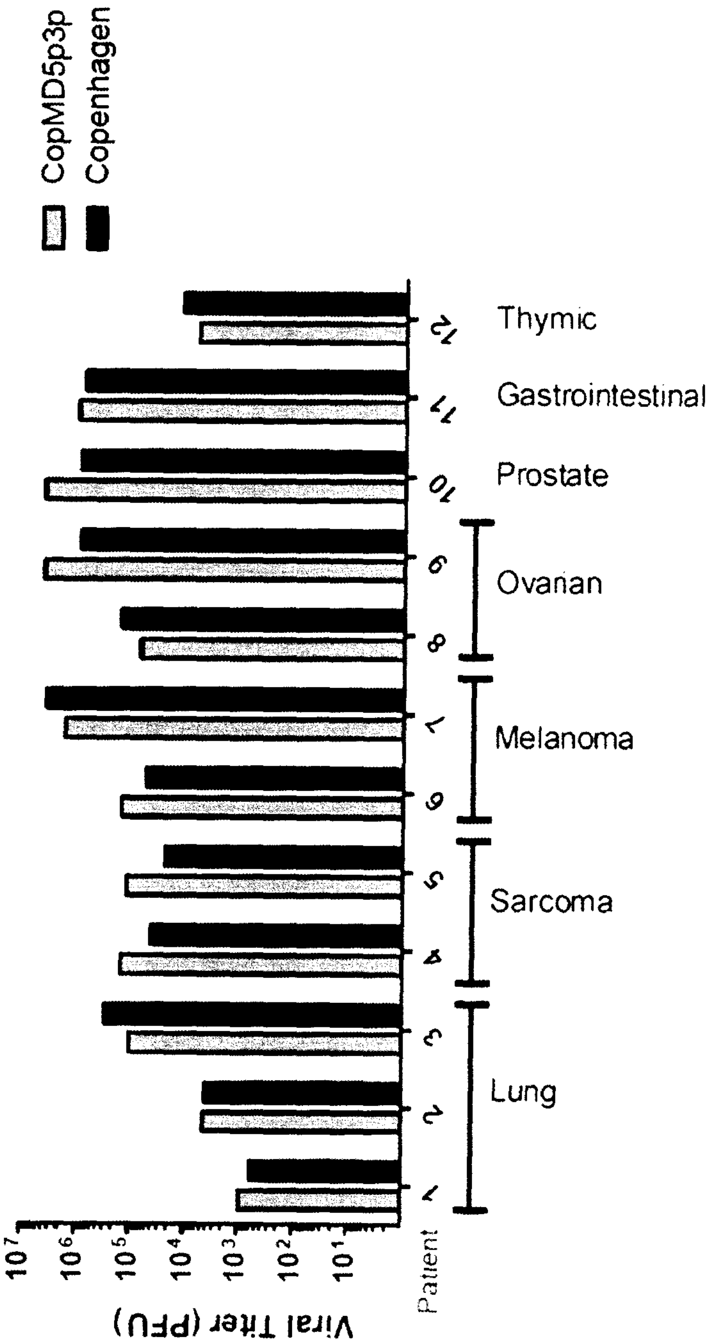
FIG. 11 shows the ability of Copenhagen and CopMD5p3p to replicate in patient ex vivo samples as shown by titering.

Patient tumor samples were obtained immediately after surgery and cut into 2 mm×2 mm cores. Three cores were infected with a small amount of virus ($1\times10^4$ PFU), either wild-type Copenhagen or CopMD5p3p. After 72h virus output was assessed by plaque assay and final Viral Titer expressed as PFU (see FIG. 11). This data shows that the modified CopMD5p3p virus can replicate in fresh patient tumor samples. Replication in patient tumor samples is a good model of replication in a patient 3D tumor.

Example 5—Syncytia in U2-OS Cells

Monolayers of U2-OS cells were infected with either Copenhagen wild-type or CopMD5p3p virus. After 2h, the media was changed for overlay media as done for a plaque assay. At 48h post infection, pictures were taken with EVOS to assess plaque phenotype (see FIG. 12). Cell fusion, also known as syncytia, is thought to help the virus spread, since uninfected cells merge with infected cells. Additionally, it has been shown that fused cells are immunogenic and in the case of cancer cells can help initiate an anti-tumor immune response. See, e.g., http://cancerres.aacrjournals.org/content/62/22/6566.long.

Example 6—Syncytia in 786-O Cells

Figure 12:
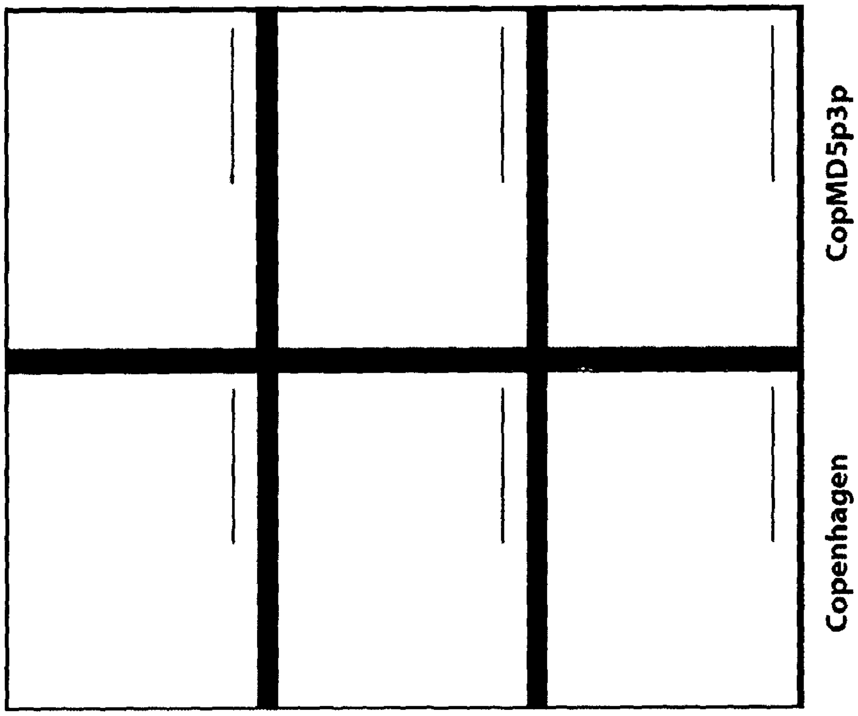
FIG. 12 shows that the modified CopMD5p3p virus forms different plaques than the parental virus. CopMD5p3p plaques are much clearer in the middle and we can see syncytia (cell fusion).
Figure 13:
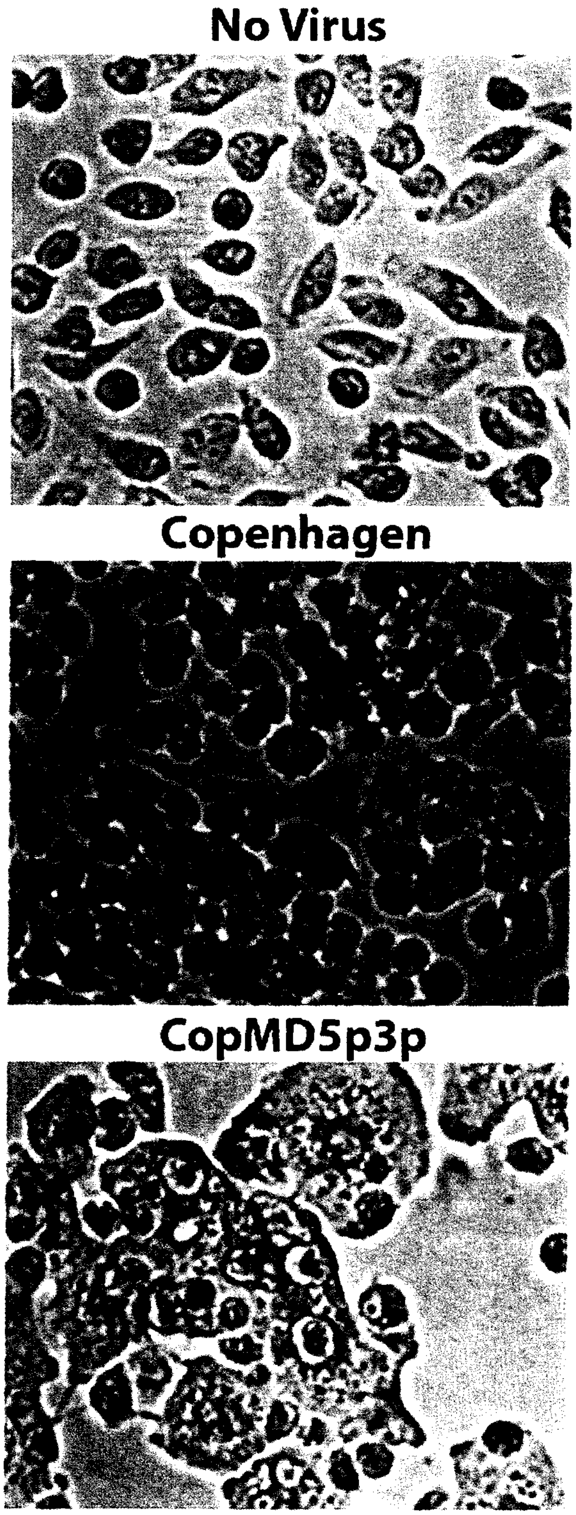
FIG. 13 shows CopMD5p3p induces syncytia (cell fusion) in 786-O cells.

Monolayers of 786-O cells were infected with either Copenhagen wild-type or CopMD5p3p virus. After 24h pictures were taken with EVOS at 10× magnification (see FIG. 13). This is additional evidence for the occurrence of syncytia. In FIG. 12, the phenotype of a plaque is shown. In the current experiment, monolayers of cells were infected without overlay. Most cells infected by the CopMD5p3p virus have fused.

Example 7—Tumor Control and Weight Loss in Mouse Model

Figure 14:
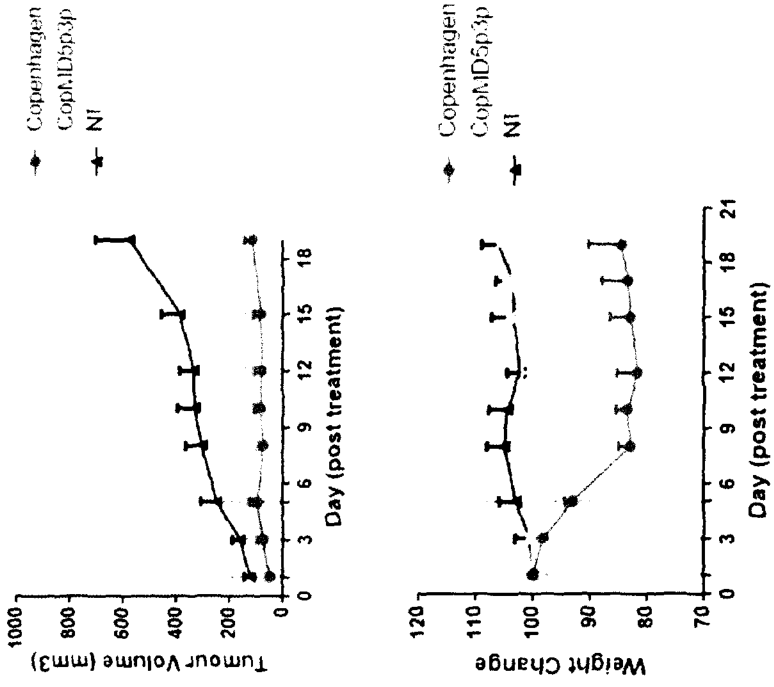
FIG. 14 shows that CopMD5p3p is able to control tumour growth similarly to Copenhagen wild-type but does not cause weight loss.

Nude CD-1 (Crl:CD1-Foxn1nu) mice were seeded with HT-29 human colon cancer xenograft (5e6 cells). Once subcutaneous tumours have established an approximate 5 mm×5 mm size, mice were treated three times (dashed lines) 24h apart with $1\times10^7$ PFU of either vaccinia virus intravenously. Mice were measured approximately every other day for tumor size and weight loss (see FIG. 14). This experiment shows that CopMD5p3p is a much safer virus because it does not cause any weight loss or other signs of sickness in immunocompromised nude mice. This experiment also shows CopMD5p3p is able to control tumor growth similarly to the parental Copenhagen wild-type virus.

Example 8—Pox Lesion Formation

Figure 15:
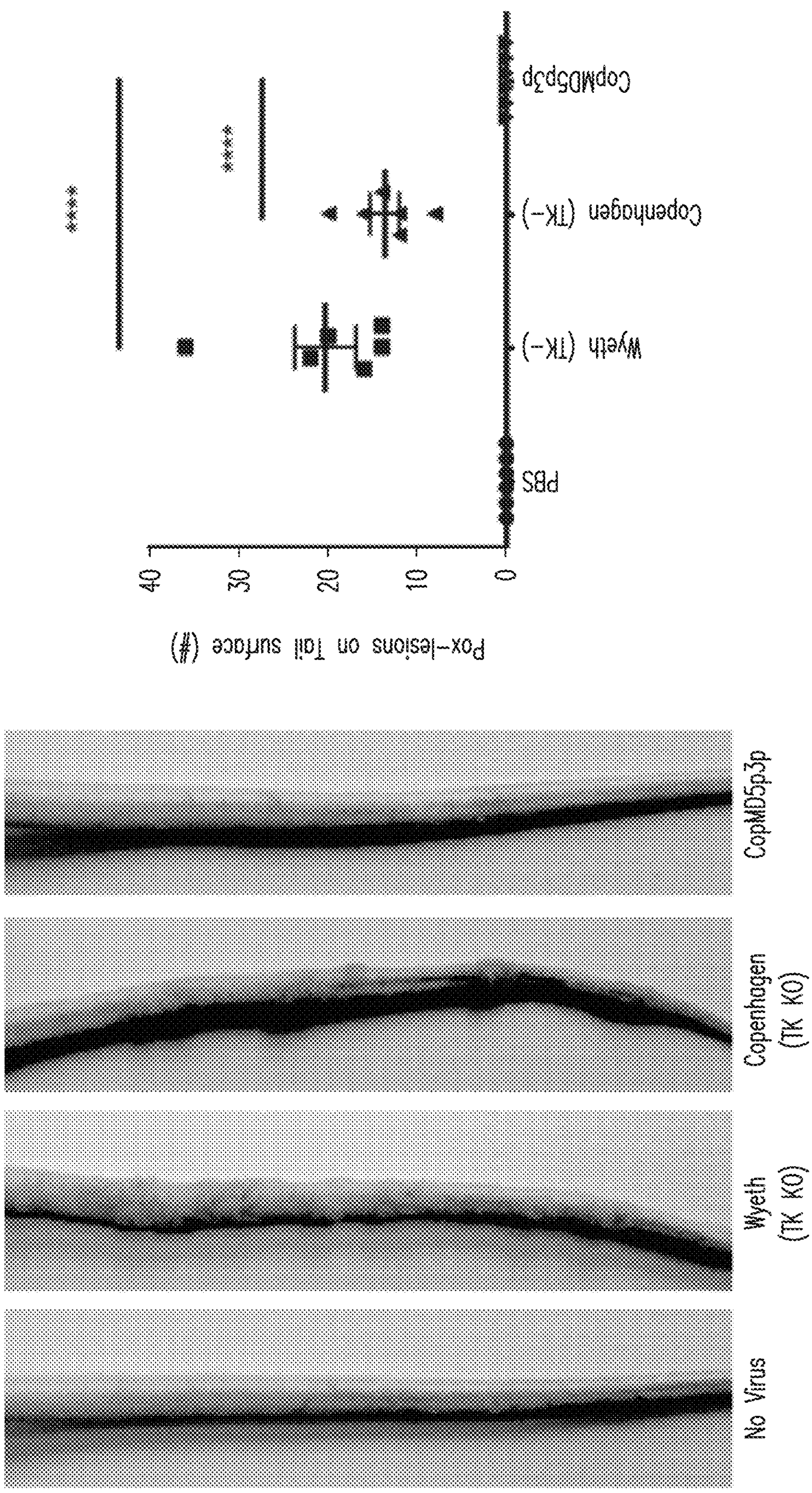
FIG. 15 shows that CopMD5p3p does not cause pox lesion formation when compared to two other Vaccinia strains (Copenhagen and Wyeth) harboring the oncolytic knockout of thymidine kinase.

Nude CD-1 mice were treated once with $1\times10^7$ PFU of either vaccinia virus intravenously, six mice per group. Two weeks post treatment, mice were sacrificed and pictures of tails were taken. Pox lesions on tails were counted manually on every mouse tail. Representative pictures shown in FIG. 15. This experiment shows that CopMD5p3p is a much safer virus because it does not cause any pox lesions in immunocompromised nude mice. This is important since prior Oncolytic Vaccinia clinical data has shown patients developing pox lesions upon treatment. Knockout of thymidine kinase (TK) is a popular way of increasing the safety of an OV (oncolytic virus), currently present in a Phase III Oncolytic Vaccinia and in FDA approved Oncolytic T-Vec. The data shows that deleting TK does not play a crucial role in this assay, where mice develop pox lesions when challenged with TK deleted viruses, but do not develop pox lesions with CopMD5p3p which has an intact TK.

Example 9—IVIS Bio-Distribution of Vaccinia after Systemic Administration

Vaccinia viruses wild-type Wyeth, wild-type Copenhagen, and CopMD5p3p were engineered to express Firefly Luciferase (Fluc) and YFP through transfection of infected cells with a pSEM1 plasmid replacing TK with Fluc and YFP. Viruses were plaque purified and expanded. All viruses are TK knockouts and encode functional Fluc in their TK locus.

Figure 16:
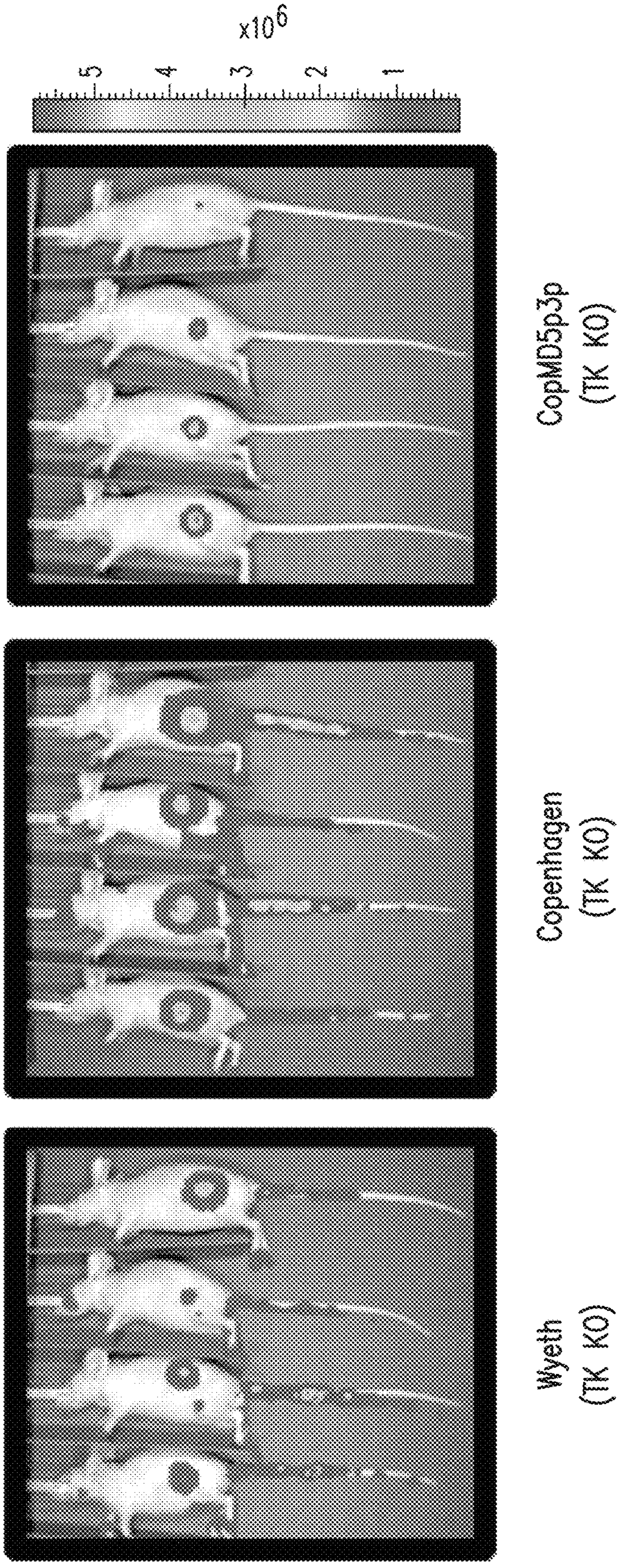
FIG. 16 shows the IVIS bio-distribution of Vaccinia after systemic administration in nude CD-1 mice. Luciferase encoding CopMD5p3p (TK KO) is tumor specific and does not replicate in off target tissues.
Figure 17:
FIG. 17 shows the bio-distribution of Vaccinia after systemic administration. CopMD5p3p replicates similarly to other oncolytic Vaccinia in the tumour but replicates less in off target tissues/organs.

Nude CD-1 mice were then seeded with HT-29 human colon cancer xenograft. Once subcutaneous tumors have established an approximate 5 mm×5 mm size, mice were treated once with 1e7 PFU of either vaccinia Fluc encoding virus intravenously, four mice per group. Four days post treatment, mice were injected i.p. (intraperitoneal) with luciferin and imaged with IVIS for presence of virus (see FIG. 16). This experiment shows that CopMD5p3p is a much safer virus because it is more specific to the tumor. Other viruses show off target replication in the tail, muscle, paws and intra-nasal cavity. CopMD5p3p is only localized in the tumor. As shown in previous FIGS. 15 and 16, there is less detectable CopMD5p3p in the tail compared to the other strains. FIG. 17 shows that CopMD5p3p also has lower titers in other organs when compared to other oncolytic Vaccinia. Since the CopMD5p3p replicates at the same level as the other viruses in the tumor but less in off-target tissues, CopMD5p3p fits the profile of an oncolytic virus better.

Figure 28:
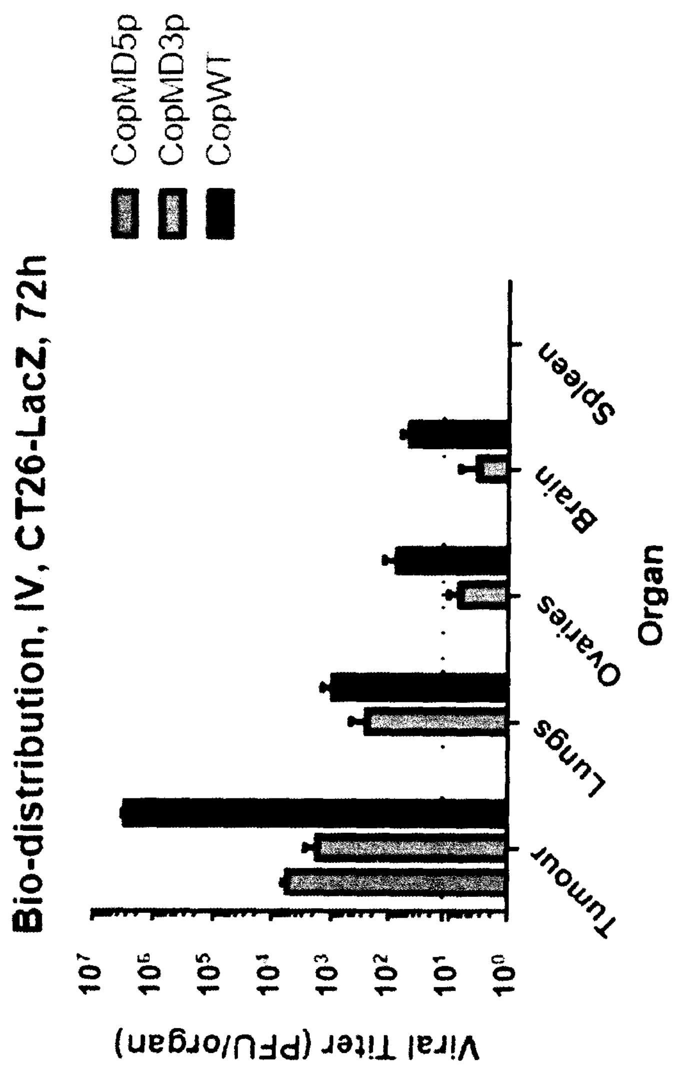
FIG. 28 shows the distribution of wild-type Copenhagen vaccinia virus and several modified Copenhagen vaccinia virions upon administration to mice.
Figure 29:
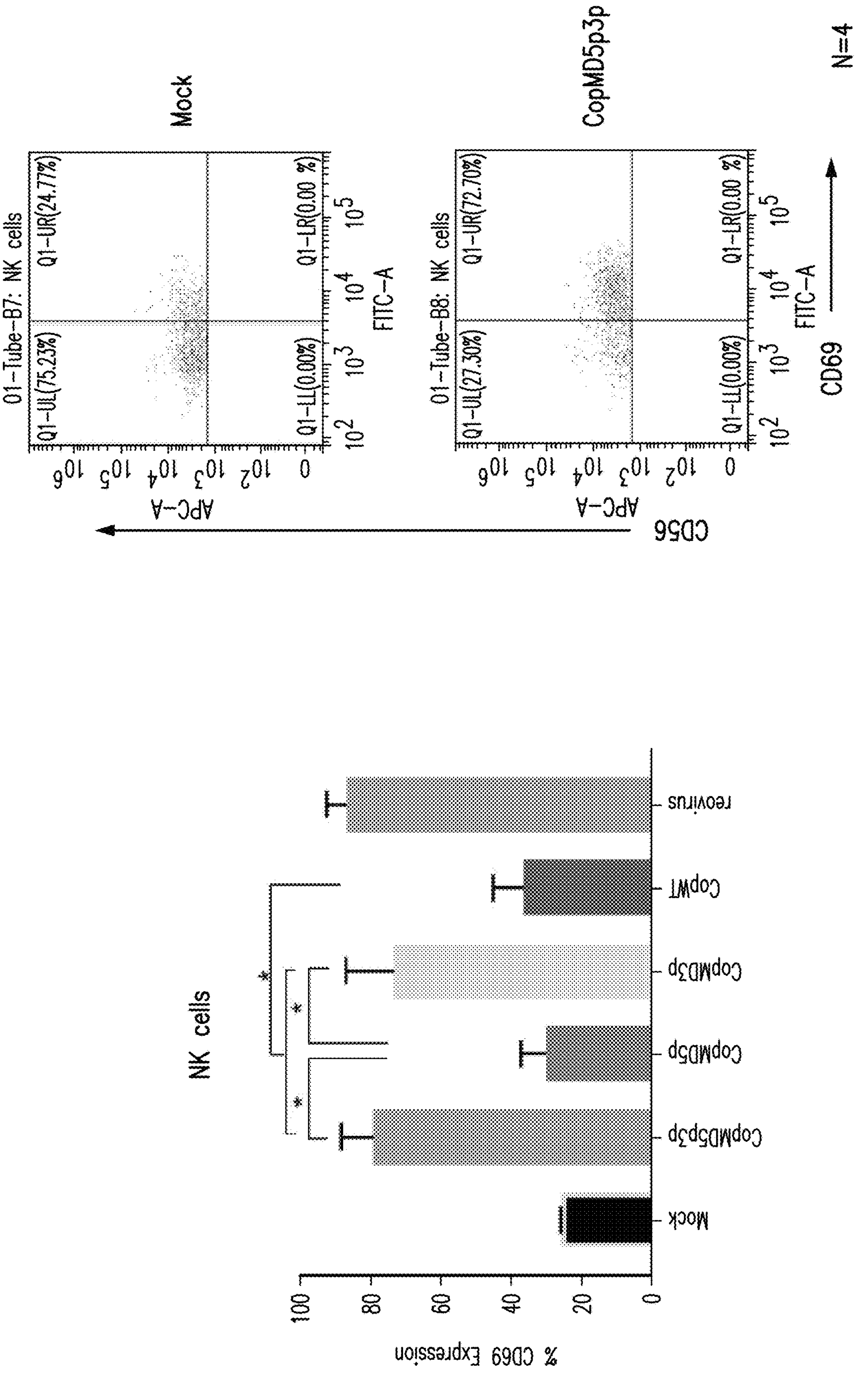
FIG. 29 shows the ability of wild-type Copenhagen vaccinia virus and several modified Copenhagen vaccinia virions to activate Natural Killer (NK) cells and stimulate an immune response.
Figure 30:
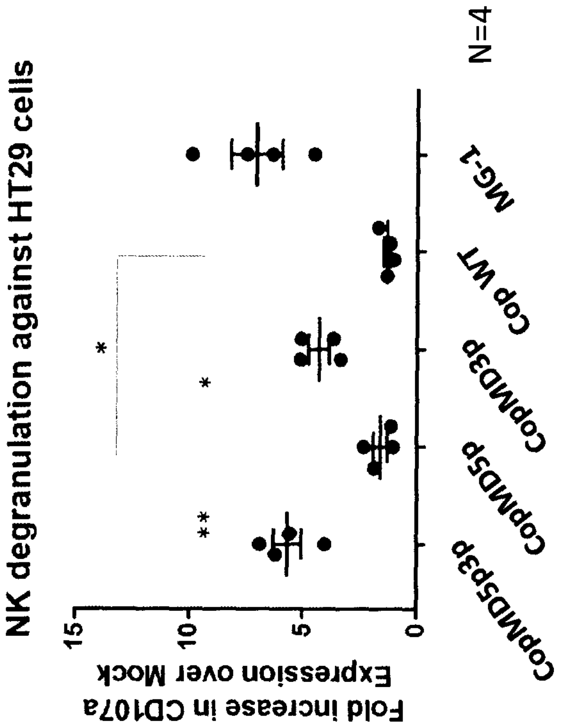
FIG. 30 shows the ability of wild-type Copenhagen vaccinia virus and several modified Copenhagen vaccinia virions to enhance NK cell-mediated degranulation against HT29 cells, a measure of NK cell activity and stimulate an immune response.
Figure 31:
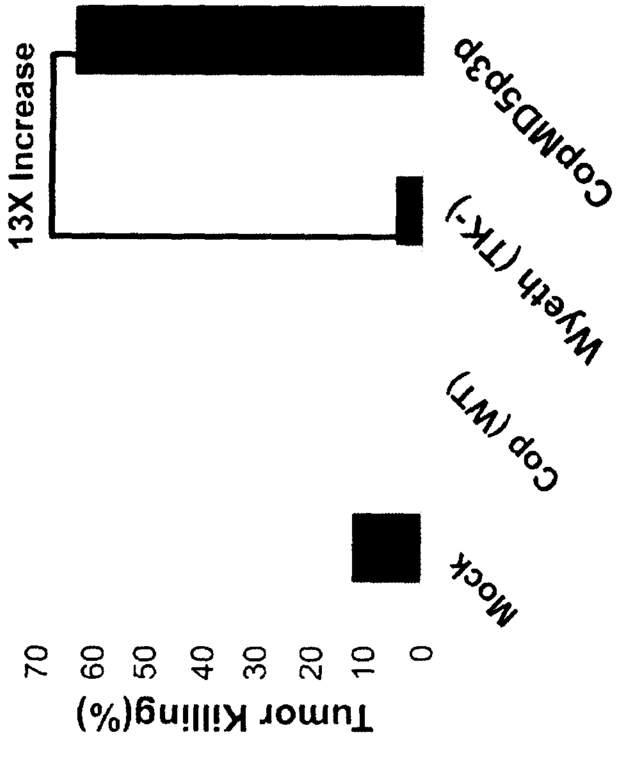
FIG. 31 shows the ability of wild-type Copenhagen vaccinia virus and several modified Copenhagen vaccinia virions to prime T-cells to initiate an anti-tumor immune response.
Figure 32:
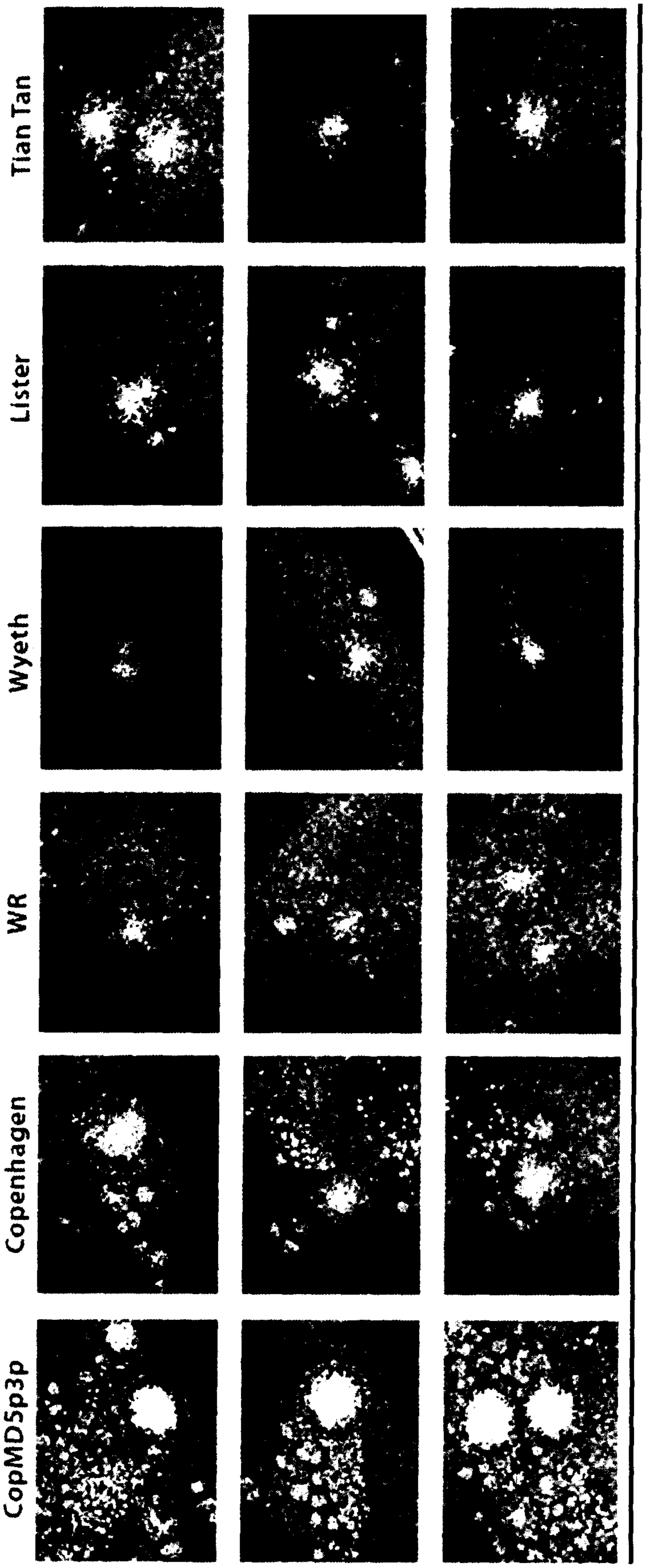
FIG. 32 shows the ability of wild-type Copenhagen vaccinia virus and several modified Copenhagen vaccinia virions to spread to distant locations from the initial point of infection.
Figure 33:
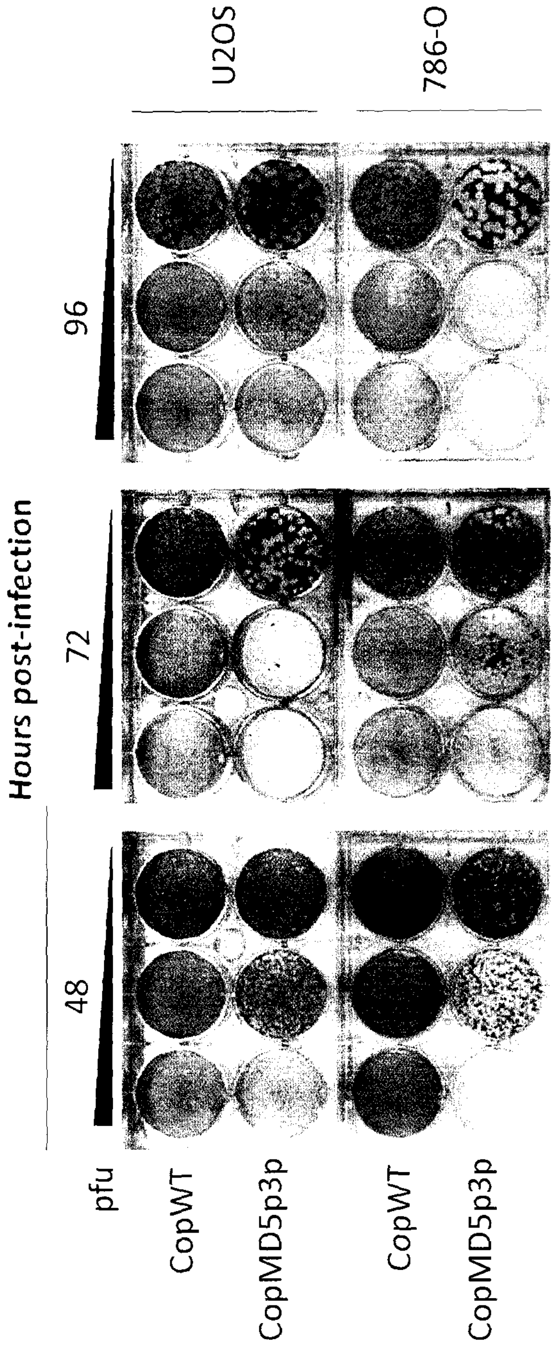
FIG. 33 shows the ability of wild-type Copenhagen vaccinia virus and several modified Copenhagen vaccinia virions to form plaques, a measure of viral proliferation.
Figure 34:
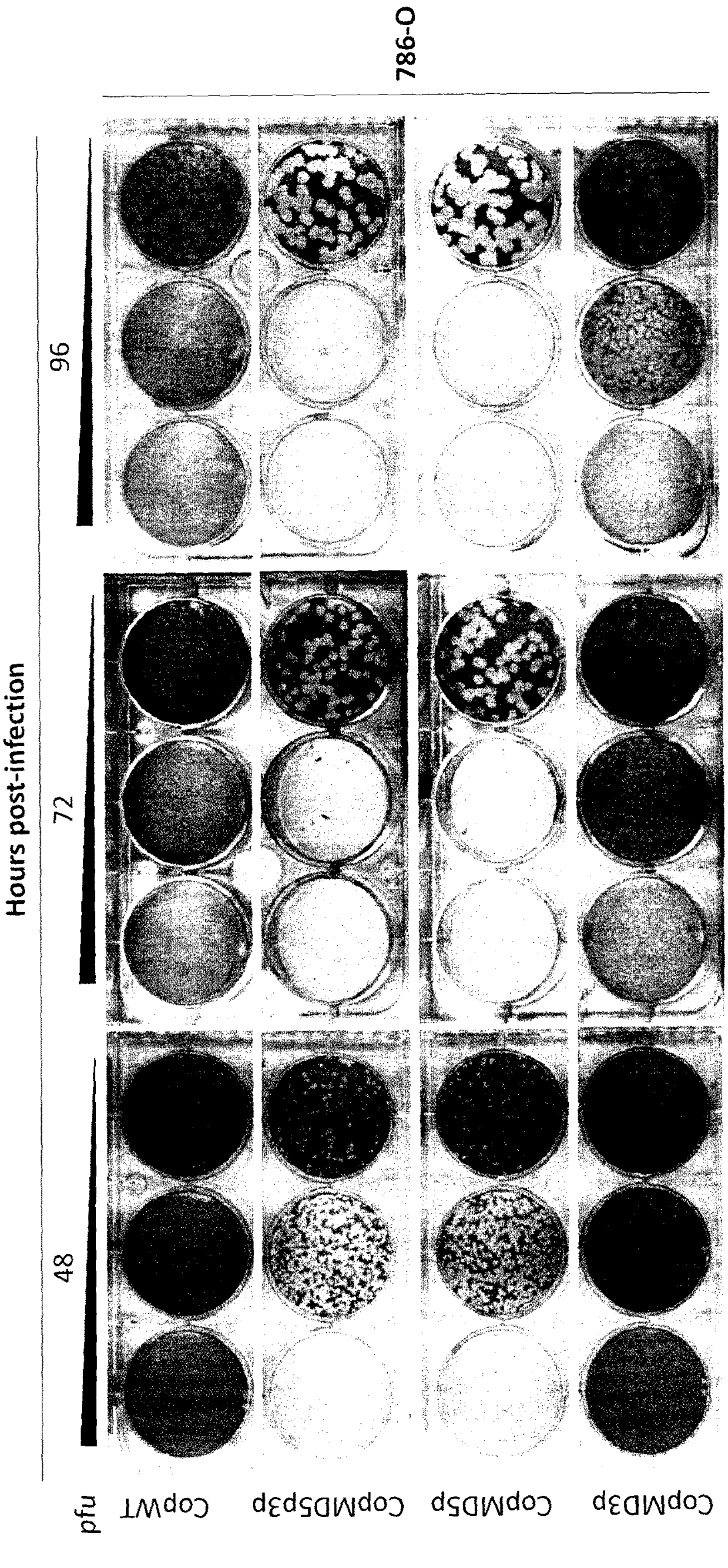
FIG. 34 shows the ability of wild-type Copenhagen vaccinia virus and several modified Copenhagen vaccinia virions to form plaques in 786-O cells.

An additional example of the biodistribution of various vaccinia viral vectors, including the wild-type Copenhagen vaccinia virus and several modified Copenhagen vaccinia virions, is shown in FIG. 28.

Example 10—Immunogenicity of Vaccinia in Human PBMCs

Figure 18:
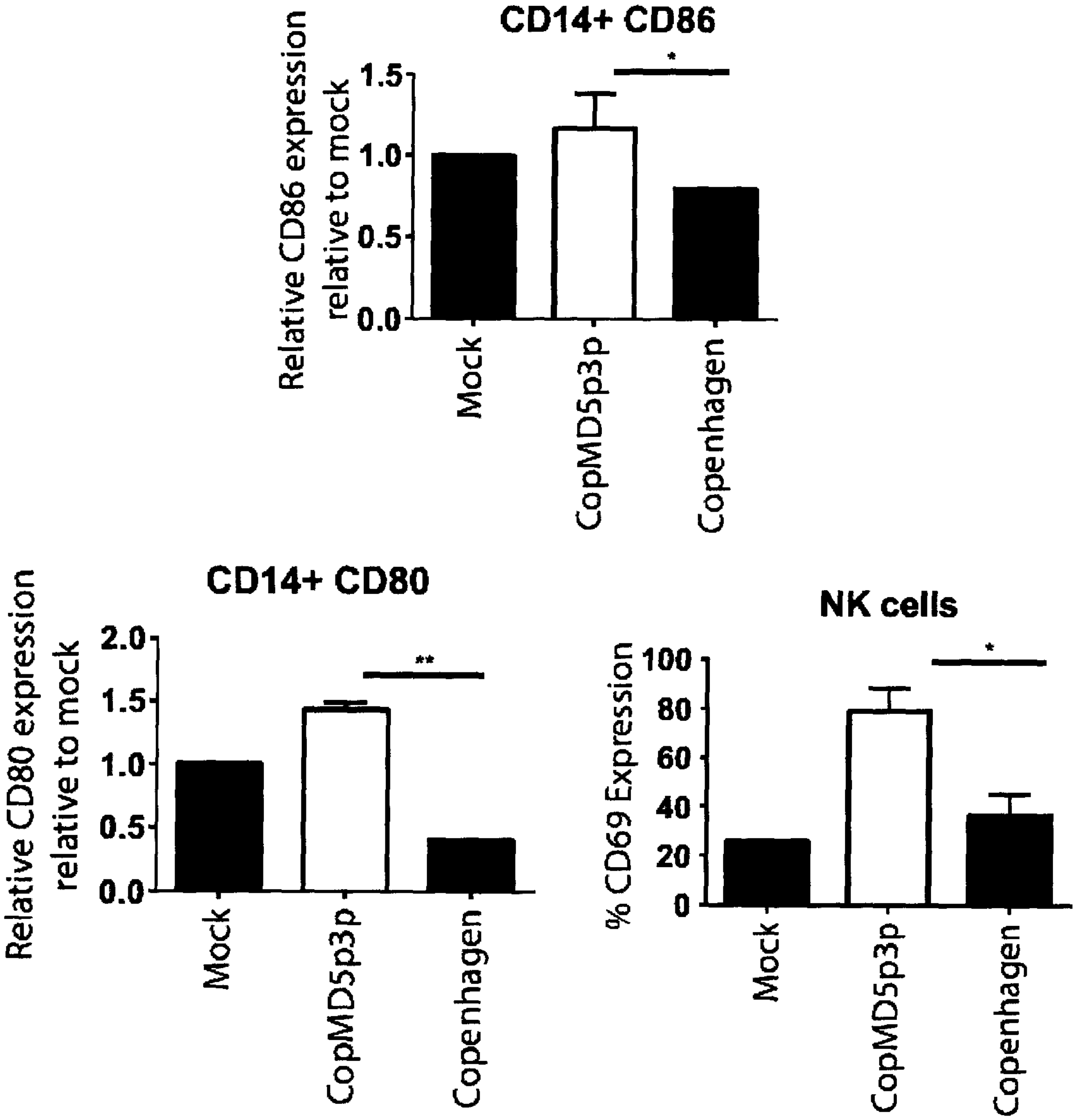
FIG. 18 shows the immunogenicity of Vaccinia in Human PBMCs. The ability of CopMD5p3p to induce human innate immune cell activation is stronger than that of wild-type Copenhagen. Data was acquired through flow cytometric analysis.

PBMCs were isolated from blood of healthy human donors (n=2). PBMCs were incubated with either Vaccinia for 24h and checked for early activation markers using Flow Cytometry (see FIG. 18). This experiment shows that CopMD5p3p is more immunogenic and more readily detectable by immune cells. We believe that this is a desirable trait, since OVs replicating in tumor tissue need to activate immune cells for a successful anti-tumor immune response.

Example 11—Immunogenicity of Vaccinia in Mouse Splenocytes

Figure 19:
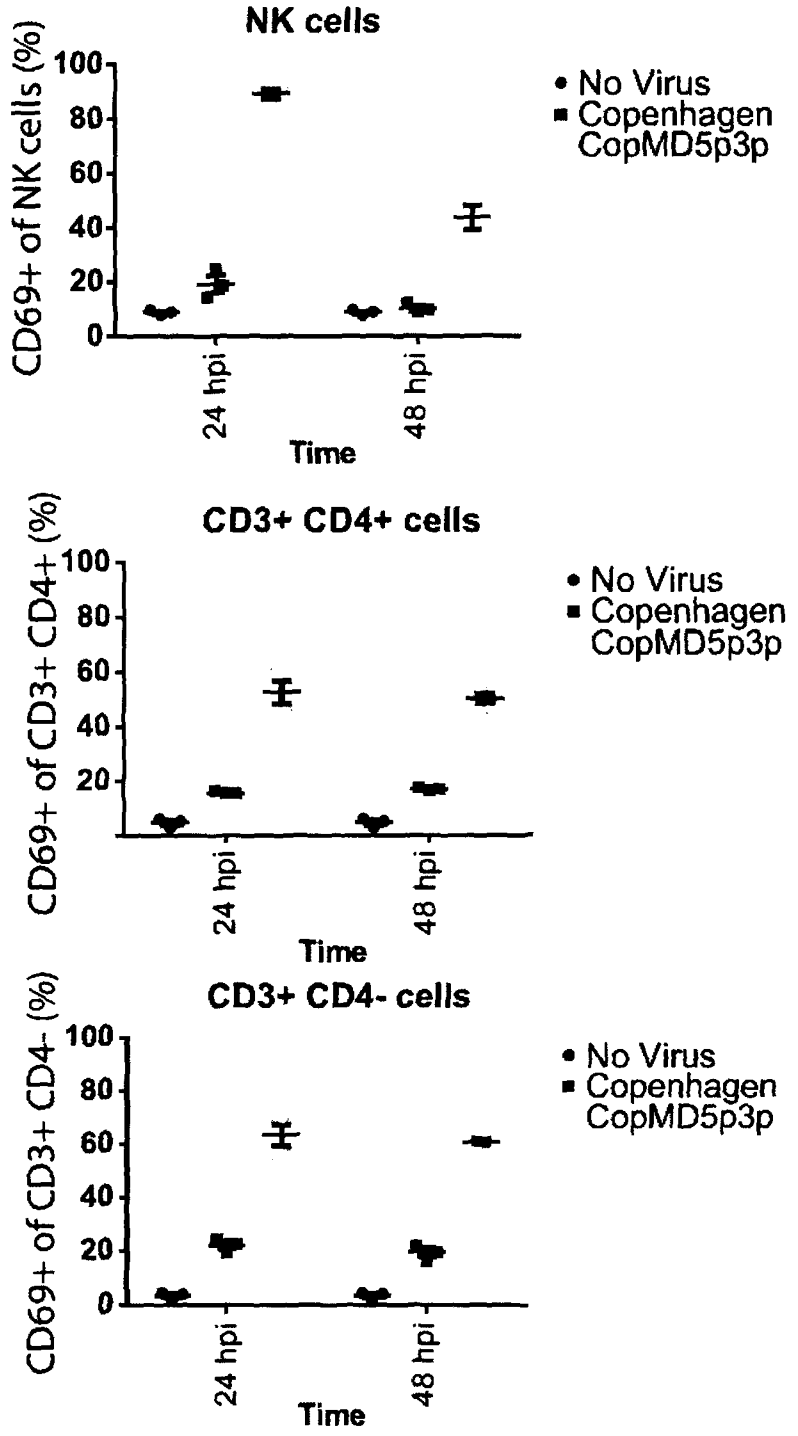
FIG. 19 shows the immunogenicity of Vaccinia in Mouse Splenocytes. The ability of CopMD5p3p to induce mouse innate immune cell activation is stronger than that of Copenhagen. Data was acquired through flow cytometric analysis.

Immune competent Balb/C mice were injected with $1\times10^7$ Vaccinia PFU Vaccinia virus intravenously. After one or two days, mice were sacrificed, spleens were harvested and analyzed for immune activation using Flow Cytometry (see FIG. 19). This experiment shows that CopMD5p3p is more immunogenic and more readily detectable by mouse immune cells. This data complements nicely the previous FIG. 18, since most of the in vivo experiments are done in mice.

Example 12—Immunogenicity of Vaccinia in Human Cells

Figure 20:
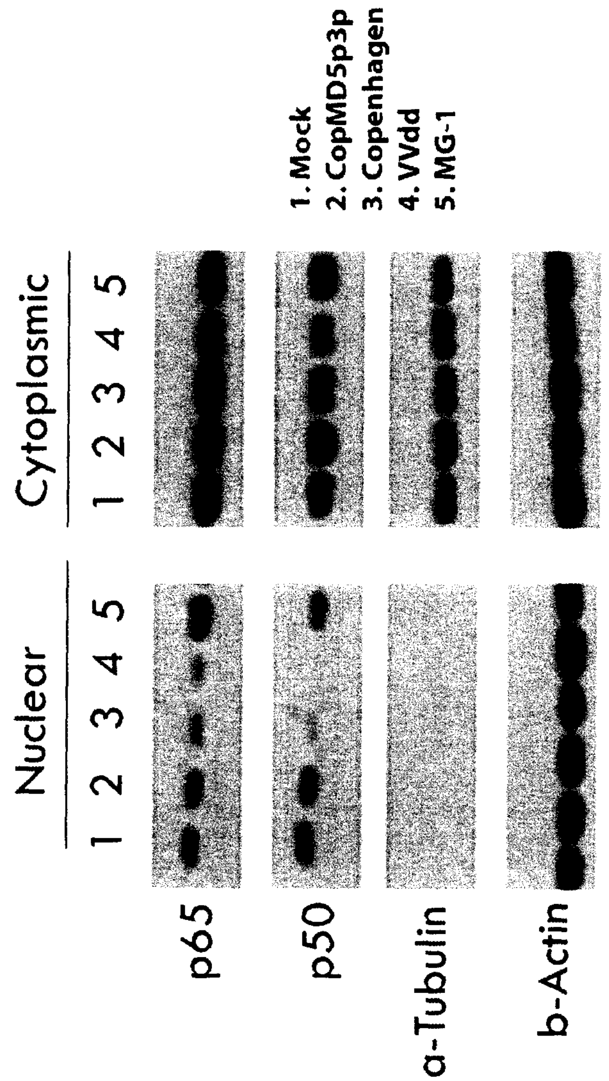
FIG. 20 shows the immunogenicity of Vaccinia in Human cells. The ability of CopMD5p3p to activate NF-kB immune transcription factor is stronger than that of Copenhagen or VVdd but similar to that of MG-1. Data shown are western blots.

Human cancer cells 786-O were infected at an MOI of 0.01 with either virus. The next day, cells were harvested and nuclei and cytoplasm were separated by cell fractionation. Protein was extracted from each fraction and blotted for NF-kB subunits p65 and p50 (see FIG. 20). NF-kB immune transcription factor initiated an immune response once its subunit p65 and p50 are translocated to the nucleus. Some viruses are immunosuppressive and block this translocation, preventing an immune response. Suppressing NF-kB function is counter-intuitive to the goal of using oncolytic viruses in combination with immunotherapeutic approaches. Thus, CopMD5p3p is a more advantageous virus as it behaves similarly to MG-1.

Figure 21:
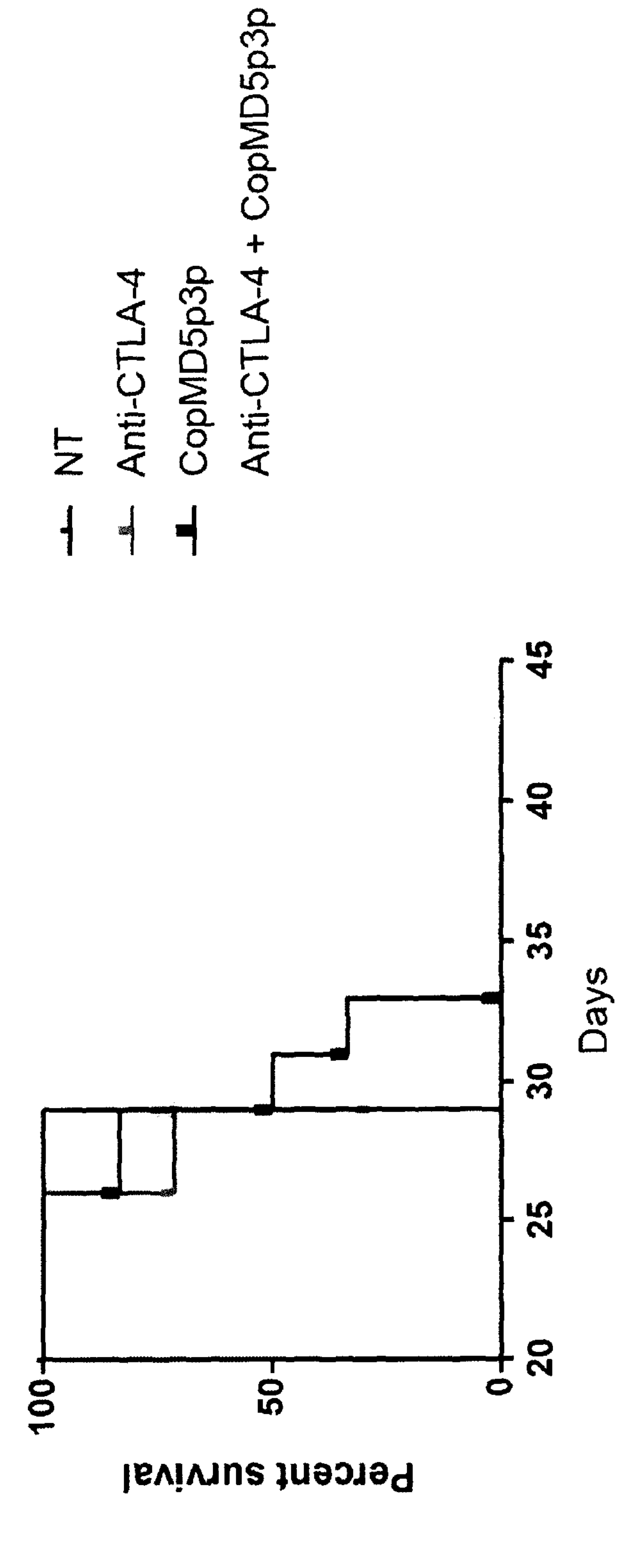
FIG. 21 shows the synergy with immune checkpoint inhibitor Anti-CTLA-4 (100 μg) in an aggressive melanoma model (B16-F10). In vivo efficacy measured by survival in an immune competent murine model treated with Vaccinia and Immune Checkpoint Inhibitors Anti-CTLA4.

Example 13—Synergy with Immune Checkpoint Inhibitor Anti-CTLA4 in Aggressive Melanoma Model Immune competent C57BL/6 mice were seeded (5e5 cells) subcutaneously with B16-F10 melanoma tumors. Treatment began once subcutaneous tumors have established an approximate 5 mm×5 mm size. Mice treated with CopMD5p3p virus received three $1\times10^7$ PFU doses into the tumor (intra-tumor) one day apart. Mice treated with anti-CTLA4 received five 100 μg doses of antibody i.p. one day apart. Survival were recorded every other day once treatment started (see FIG. 21). In this experiment, we tested if the oncolytic effect of our CopMD5p3p virus can synergize with blockade of a well-known immune checkpoint CTLA-4 in a very aggressive melanoma murine model. Surprisingly, the median survival of mice treated with virus and checkpoint was higher than any other group. This suggests that CopMD5p3p has some stimulating properties that synergize with checkpoint blockade immunotherapy.

Example 14—Synergy with Immune Checkpoint Inhibitor Anti-CTLA4

Figure 22:
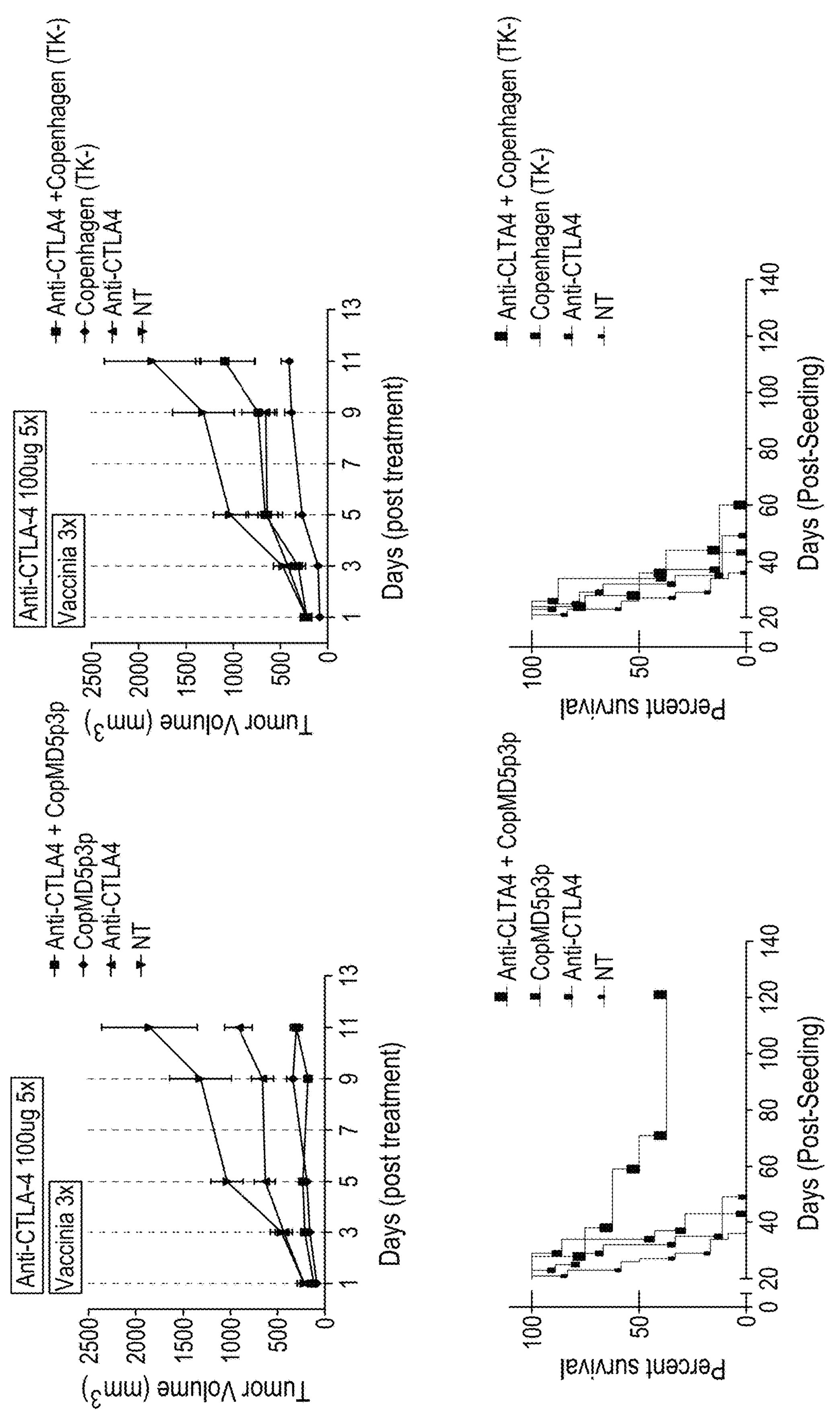
FIG. 22 shows the synergy with immune checkpoint inhibitor Anti-CTLA4 (100 μg). In vivo efficacy measured by tumor growth (top row) and survival (bottom row) in an immune competent murine model treated with Vaccinia and Immune Checkpoint Inhibitor Anti-CTLA4. CopMD5p3p (left column) is compared to oncolytic Copenhagen TK KO (right column).

Immune competent Balb/C mice were seeded ($5\times10^5$ cells) subcutaneously with CT26-LacZ tumors. Treatment began once subcutaneous tumors have established an approximate 5 mm×5 mm size. Mice treated with Vaccinia virus received three (24h apart, first three dashed lines) 1e7 PFU doses into the tumour (intra-tumour). Mice treated with Anti-CTLA4 received five (24h apart, dashed lines) 100 μg doses of antibody i.p. Tumor size and survival were recorded every other day once treatment started (see FIG. 22). The data shows that a TK knockout Vaccinia virus does not work as well with Anti-CTLA4 as does CopMD5p3p. This suggests CopMD5p3p is more immunogenic and more capable of generating an anti-tumour immune response.

Example 15—Synergy with Immune Checkpoint Inhibitor Anti-PD1

Immune competent Balb/C mice were seeded ($5\times10^5$ cells) subcutaneously with CT26-LacZ tumors. Treatment began once subcutaneous tumors have established an approximate 5 mm×5 mm size. Mice treated with Vaccinia virus received three (24h apart, first three dashed lines) 1e7

Figure 23:
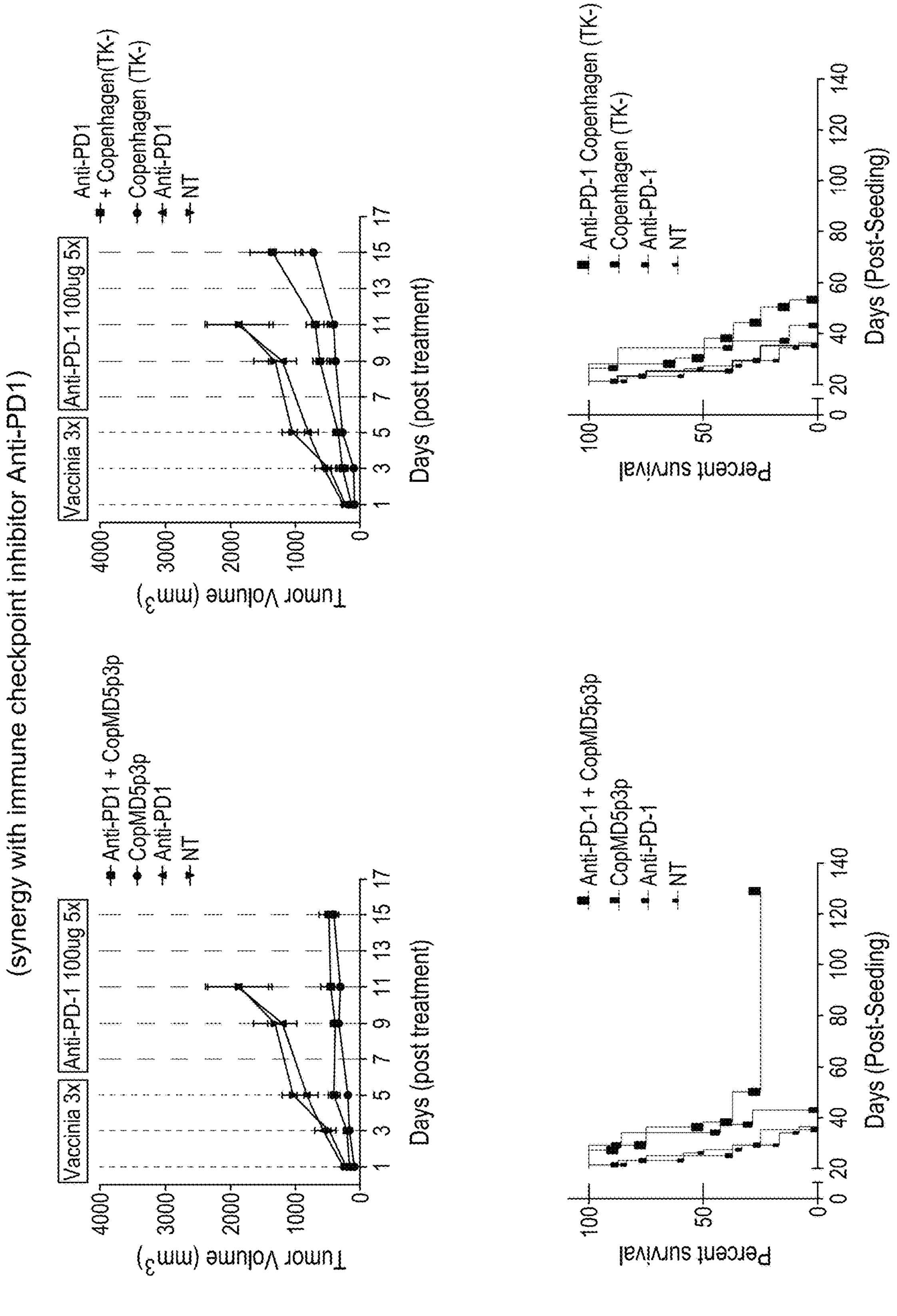
FIG. 23 shows the synergy with immune checkpoint inhibitor Anti-PD1 (100 μg). In vivo efficacy measured by tumor growth (top row) and survival (bottom row) in an immune competent murine model treated with Vaccinia and Immune Checkpoint Inhibitor Anti-PD1. CopMD5p3p (left column) is compared to oncolytic Copenhagen TK KO (right column).

PFU doses into the tumor (intra-tumor). Mice treated with Anti-PD1 received five (24h apart, last five dashed lines) 100 μg doses of antibody i.p. 24h after the last dose of Vaccinia virus. Tumor size and survival were recorded every other day once treatment started (see FIG. 23). The data shows that a TK knockout Vaccinia virus does not work as well with Anti-PD1 as does CopMD5p3p. This suggests CopMD5p3p is more immunogenic and more capable of generating an anti-tumor immune response.

Example 16—Synergy with Immune Checkpoint Inhibitor Anti-PD1 and Anti-CDLA4

Figure 24:
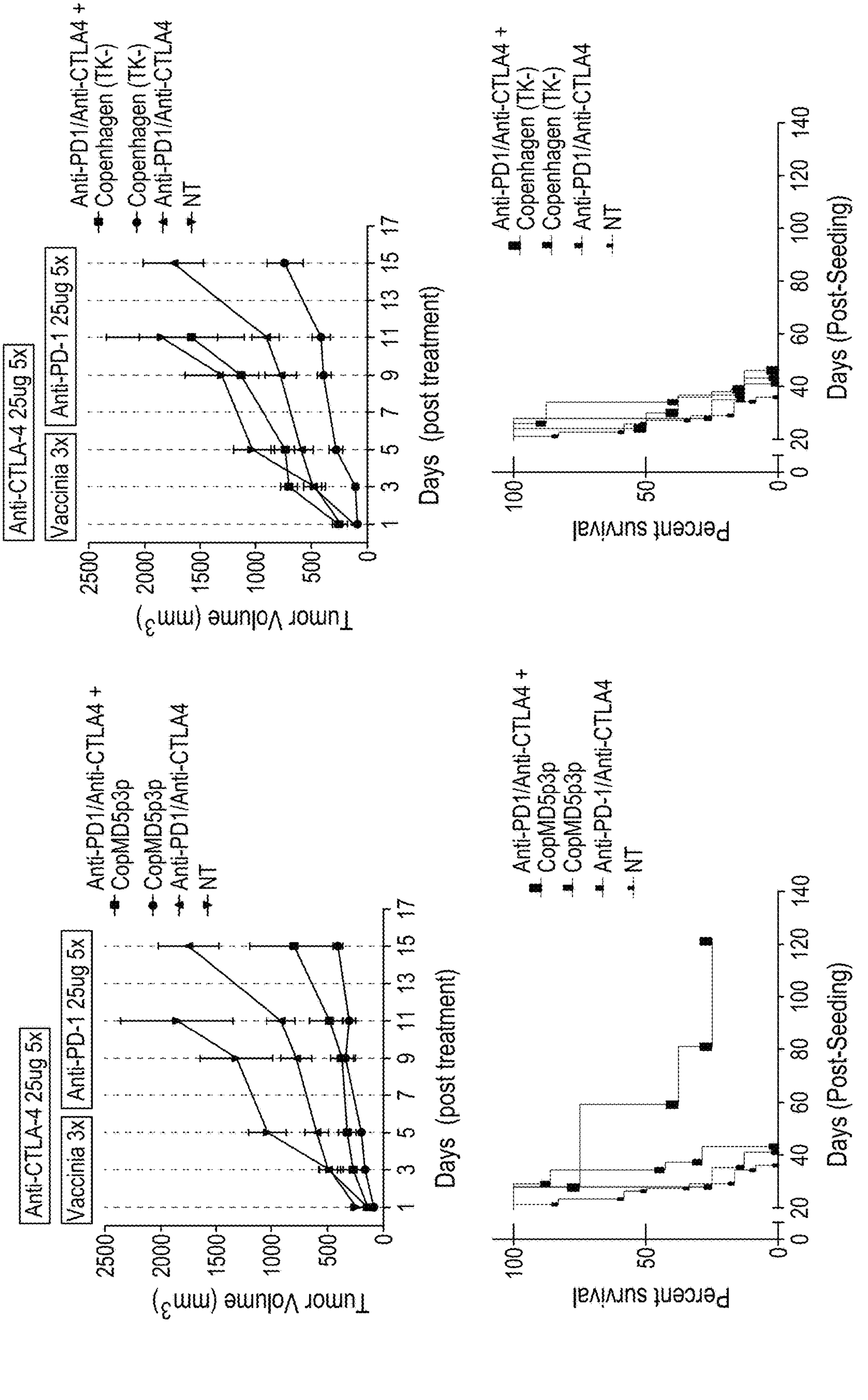
FIG. 24 shows the synergy with immune checkpoint inhibitor Anti-PD1 (25 μg) and Anti-CTLA-4 (25 μg). In vivo efficacy measured by tumor growth (top row) and survival (bottom row) in an immune competent murine model treated with Vaccinia and Immune Checkpoint Inhibitors Anti-PD1 and Anti-CTLA4. CopMD5p3p (left column) is compared to oncolytic Copenhagen TK KO (right column).

Immune competent Balb/C mice were seeded ($5\times10^5$ cells) subcutaneously with CT26-LacZ tumors. Treatment began once subcutaneous tumors have established an approximate 5 mm×5 mm size. Mice treated with Vaccinia virus received three (24h apart, first three dashed lines) $1\times10^7$ PFU doses into the tumor (intra-tumor). Mice treated with Anti-CTLA4 received five (24h apart, first five dashed lines) 100 μg doses of antibody i.p. Mice treated with Anti-PD1 received five (24h apart, last five dashed lines) 100 μg doses of antibody i.p. 24h after the last dose of Vaccinia virus. Tumor size and survival were recorded every other day once treatment started (see FIG. 24). In this experiment we tested whether a lower dose (25 μg instead of 100 μg) of checkpoint inhibitor antibody could work if we blocked both checkpoints simultaneously. The CopMD5p3p still managed to achieve cures in this murine model with a lower dose (50 μg total) of both inhibitors of checkpoints. Since checkpoint inhibitors have dose dependent toxicity, it is advantageous that very small doses of checkpoint blockers can still achieve an observable phenotype. As in other experiments, the CopMD5p3p virus manages to cure established tumors, and this effect is not observed with wild-type virus lacking the corresponding deletions of CopMD5p3p.

Example 17—Administration for the Treatment of a Subject

Using the methods described herein, a clinician of skill in the art can administer to a subject (e.g., a patient) a pharmaceutical composition containing a recombinant orthopoxvirus vector described herein to treat cancer or tumor cells. The cancer may be, for example, leukemia, lymphoma, liver cancer, bone cancer, lung cancer, brain cancer, bladder cancer, gastrointestinal cancer, breast cancer, cardiac cancer, cervical cancer, uterine cancer, head and neck cancer, gallbladder cancer, laryngeal cancer, lip and oral cavity cancer, ocular cancer, melanoma, pancreatic cancer, prostate cancer, colorectal cancer, testicular cancer, or throat cancer, among others.

For instance, a clinician of skill in the art may assess that a patient is suffering from cancer or tumors and may administer to the patient a therapeutically effective amount (e.g., an amount sufficient to decrease the size of the tumor) of a pharmaceutical composition containing the recombinant orthopoxvirus vector disclosed herein. The pharmaceutical composition may be administered to the subject in one or more doses (e.g., 1, 2, 3, 4, 5, 6, 7, 8, 9, 10, 15, 20, 25, or more) per a specified time interval (e.g., weekly, daily, or hourly). The patient may be evaluated between doses to monitor the effectiveness of the therapy and to increase or decrease the dosage based on the patient's response. The pharmaceutical composition may be administered to the patient orally, parenterally (e.g., topically), intravenously, intramuscularly, subcutaneously, or intranasally. The treatment may involve a single dosing of the pharmaceutical composition. The treatment may involve continued dosing of the pharmaceutical composition (e.g., days, weeks, months, or years). The treatment may further involve the use of another therapeutic agent (e.g., an immune checkpoint inhibitor, such as an anti-PD-1 or anti-CTLA-4 antibody or antigen-binding fragment thereof, IL-12, FLT3L).

Example 18—Targeted Deletions of CopMD5p and CopMD3p

The following protocol for producing modified vaccinia viral vectors utilizes techniques described, e.g., in Rintoul et al. PLoS One. 6(9): e24643 (2011), the disclosure of which is incorporated herein by reference.

Briefly, CopMD5p (Copenhagen vaccinia virus harboring deletions in 5' genes: C2L, C1L, N1L, N2L, M1L, M2L, K1L, K2L, K3L, K4L, K5L, K6L, K7R, F1L, F2L, F3L) and CopMD3p (Copenhagen vaccinia virus harboring deletions in 3' genes: (B14R, B15R, B16R, B7L, B18R, B19R, and B20R as well as single deletions in each of the ITR genes B21R, B22R, B23R, B24R, B25R, B26R, B27R, B28R, and B29R targeting recombinant constructs were synthesized by g-Block technology (IDT, Coralville Iowa). U2OS cells were infected with wildtype vaccinia virus (Wyeth, Western Reserve, Tian Tan, Lister) at an MOI of 0.01 in serum free DMEM for 1.5 hours. Viral supernatant was aspirated and U2OS cells were transfected with PCR amplified CopMD5p or CopMd3p targeting g-Blocks by Lipofectamine 2000 (Invitrogen) in OptiMEM (Gibco). DMEM supplemented with 10% FBS was added to cells 30 minutes after transfection and left overnight. The following day, transfection media was aspirated and fresh DMEM 10% FBS media was added to cells. 48 hours after infection transfection, U2OS cells were harvested and lysed by a single freeze thaw cycle. Serially diluted lysates were plated onto a confluent monolayer of U2OS cells and eGFP positive (CopMD5p targeted) or mCherry positive (CopMd3p targeted) plaques were isolated and purified through 5 rounds of plaque purifications.

Double major deleted vaccinia viruses were generated by co-infection of CopMD5p and CopMd3p deleted vaccinia viruses at an MOI of 5 for each virus in U2OS cells. Cells were harvested the next day and lysed by one round of freeze thaw. Lysates were serially diluted and plated onto a confluent monolayer of U2OS cells and selected for double positive plaques (eGFP+mCherry). Plaques were purified by 5 rounds of plaque purification.

Figure 25:
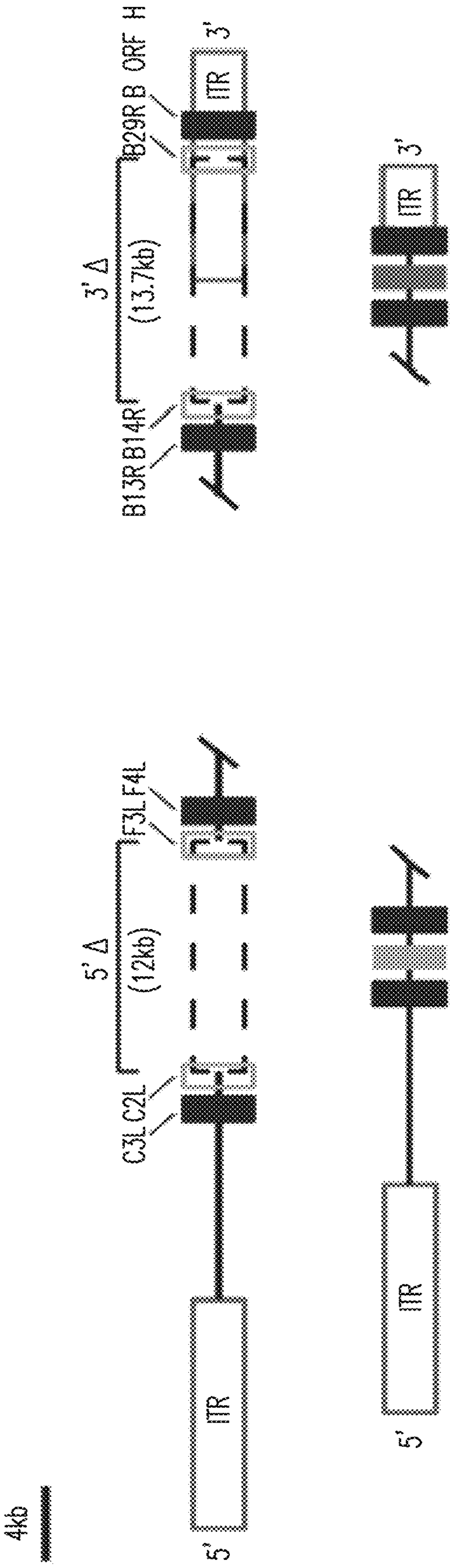
FIG. 25 shows a schematic representation of the homologous recombination targeting strategy employed to generate denovo 5p (left) and 3p (right) major deletions in various vaccinia strains.
Figure 26:
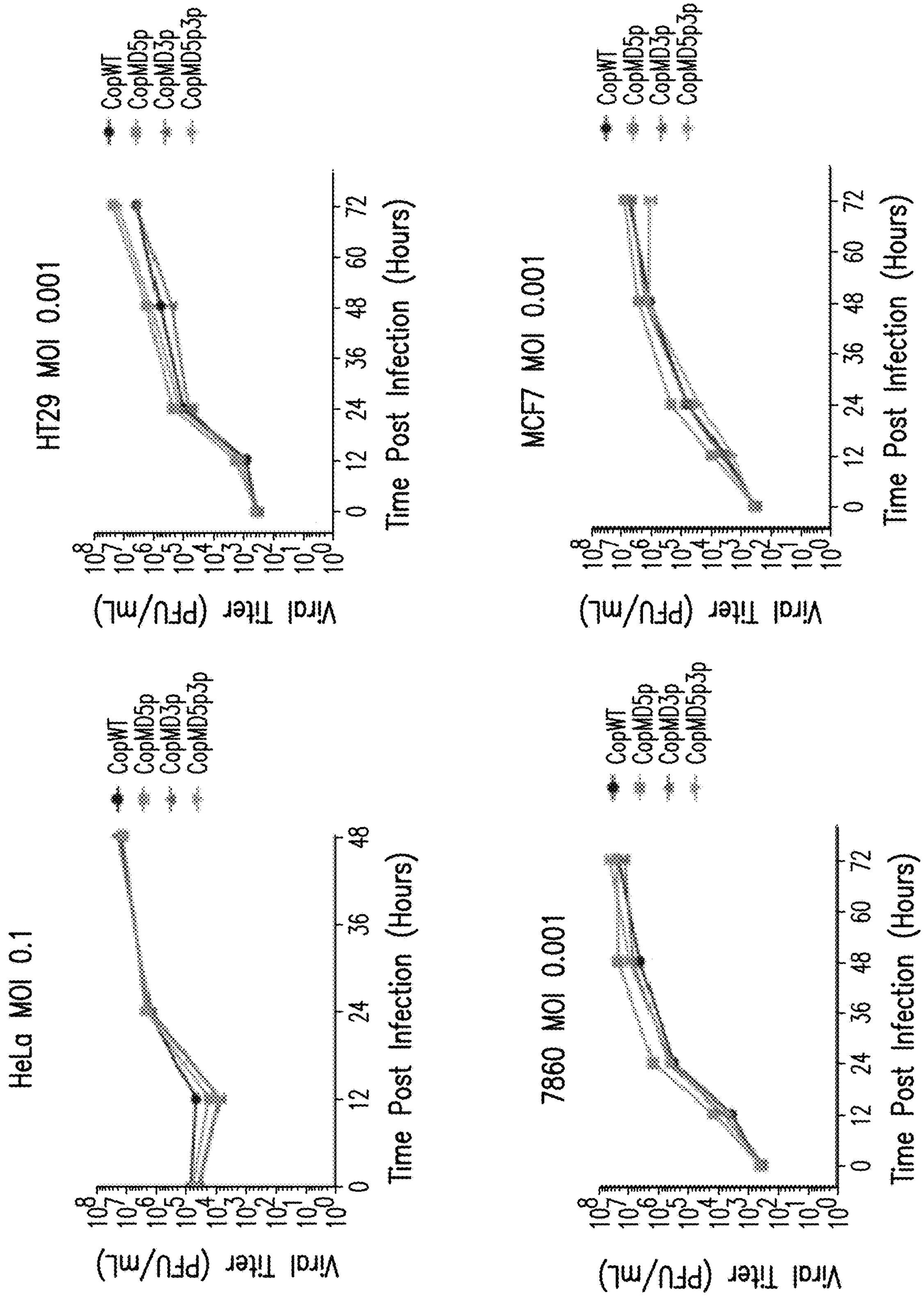
FIG. 26 shows the ability of wild-type Copenhagen vaccinia virus and several modified Copenhagen vaccinia virions to proliferate in various cell lines.
Figure 26:
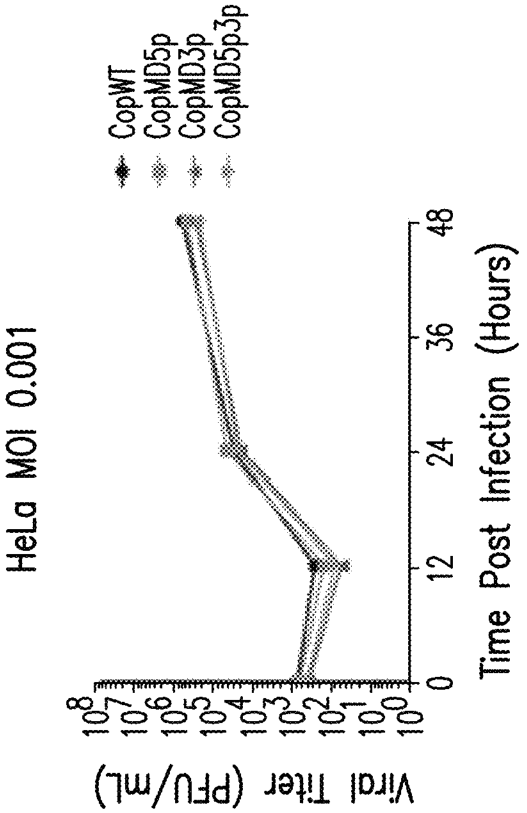
Figure 27:
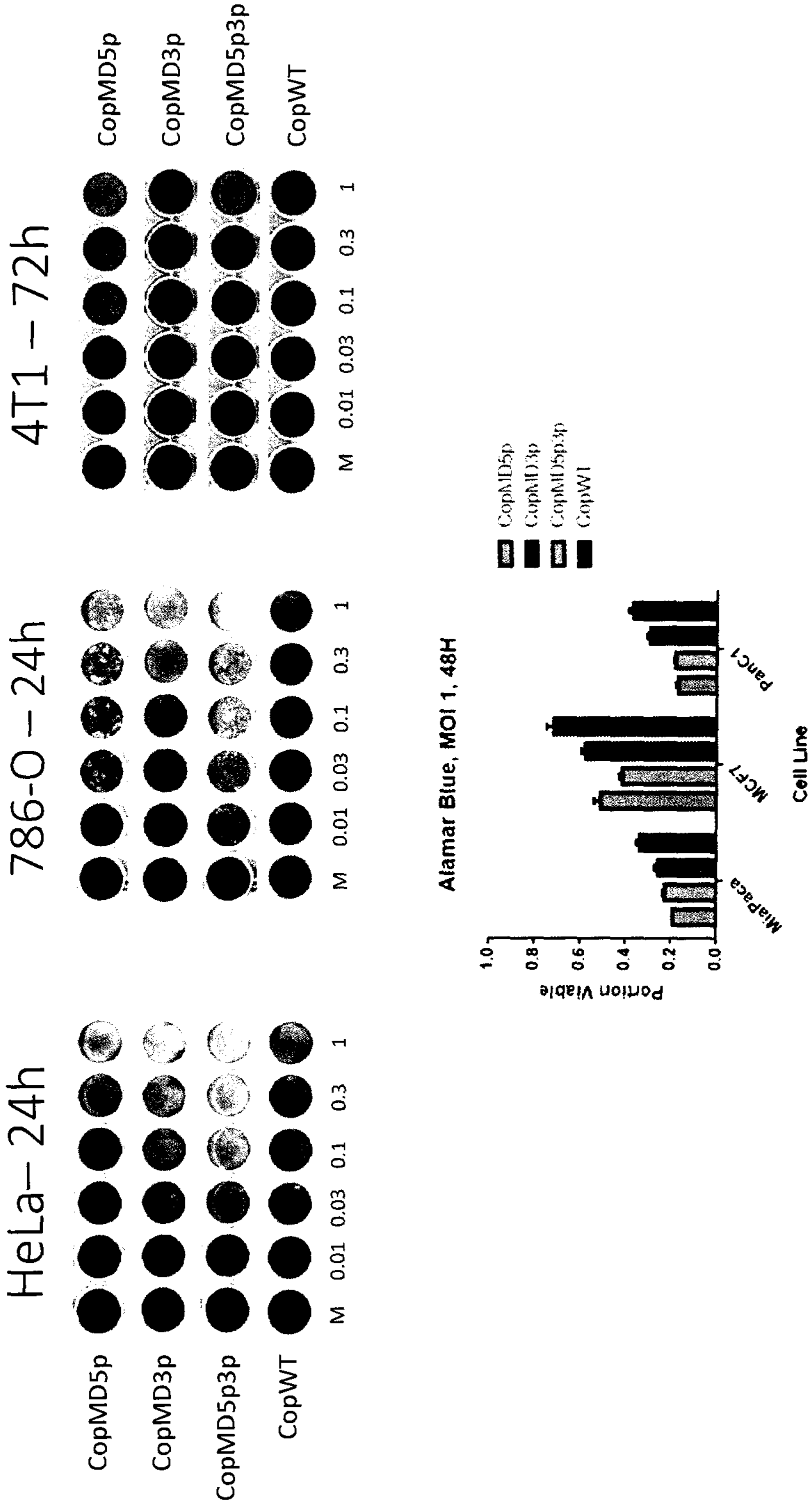
FIG. 27 shows the cytotoxic effects of wild-type Copenhagen vaccinia virus and several modified Copenhagen vaccinia virions on various cell lines, as assessed by coomassie blue (upper panel) and an Alamar Blue assay (lower panel). The order of strains listed for each cell line along the x-axis of the chart shown in the lower panel is as follows: from left to right, CopMD5p, CopMD5p3p, CopMD3p, and CopWT.

An exemplary scheme for the production of modified orthopoxvirus vectors (e.g., modified vaccinia viral vectors, such as modified Copenhagen vaccinia viral vectors) of the disclosure is shown in FIG. 25.

Example 19—SKV-GFP (CopMD5p3p-B8R−) has Similar Efficacy in Tumour Control Compared to SKV (CopMD5p3p-B8R+)

The vaccinia virus (VV) B8R gene encodes a secreted protein with homology to gamma interferon receptor (IFN-γ). In vitro, the B8R protein binds to and neutralizes the antiviral activity of several species of gamma inteterferon including human and rat gamma interferon; it does not, however, bind significantly to murine IFN-γ. Here we describe the construction and characterization of recombinant VVs lacking the B8R gene. Homologous recombination between the targeting construct and the B8R locus resulted in the replacement of 75% of the B8R gene with the eGFP transgenes flanked by two loxP sites (SKV-GFP).

Figure 38:
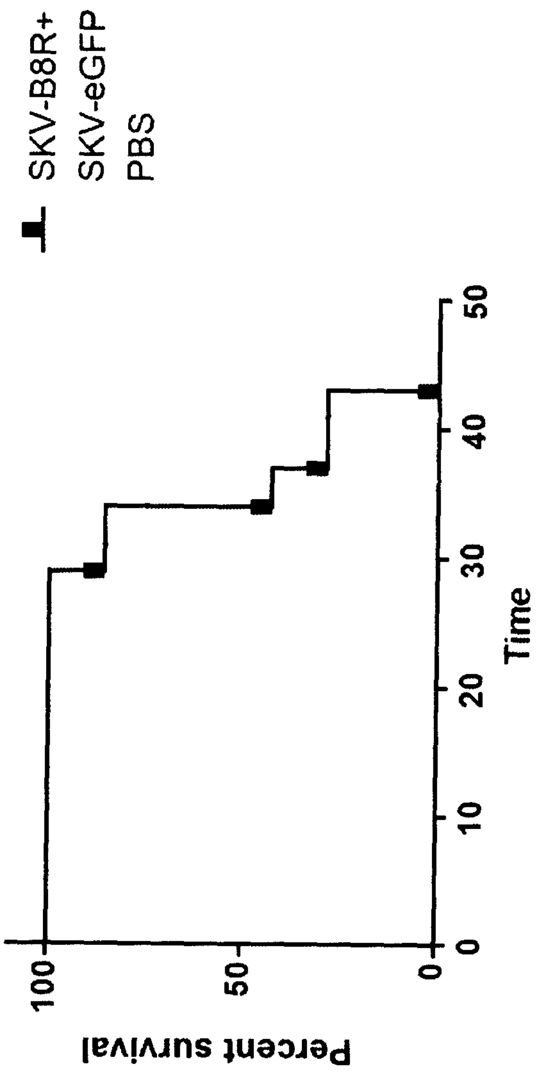
FIG. 38 shows SKV (CopMD5p3-B8R−) has similar efficacy in tumour control compared to SKV-B8R+.

B8R-viruses showed similar efficacy to B8R+ viruses. FIG. 38. Survival of mice treated with either SKV or SKV-GFP was assessed. $5\times10^6$ CT26-LacZ cells were seeded subcutaneously on day 0. On day 14, 16 and 18 tumours were treated at a dose of 107 pfu with an intratumoural injection of either SKV or SKV-GFP. No significant decrease in efficacy was seen when the viruses injected had a deletion of the B8R locus.

Figure 36:
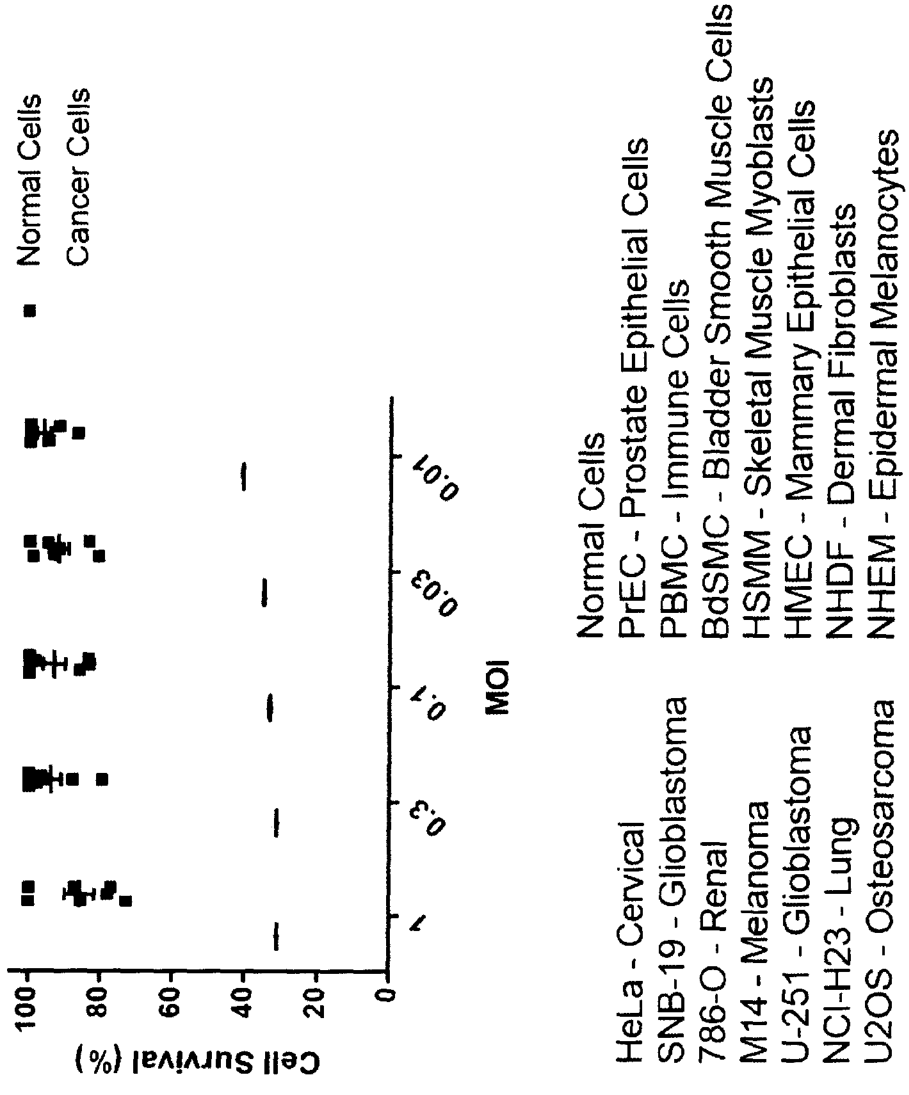
FIG. 36 shows infection of normal versus cancer cell lines of SKV-B8R+ virus.

Example 20—Infection of Normal Versus Cancer Cell Lines of SKV (CopMD5p3p-B8R+) Virus Primary health cell viability was compared to that of cancer cells. Confluent normal or cancer cells were infected at a range of MOI (pfu/cell) for 48 hrs, after which viability was quantified. As indicated in FIG. 36, SKV-B8R+ virus preferentially infects cancer cells.

Example 21—SKV (CopMD5p3p-B8R+) does not Impair Interferon Signaling

Figure 37:
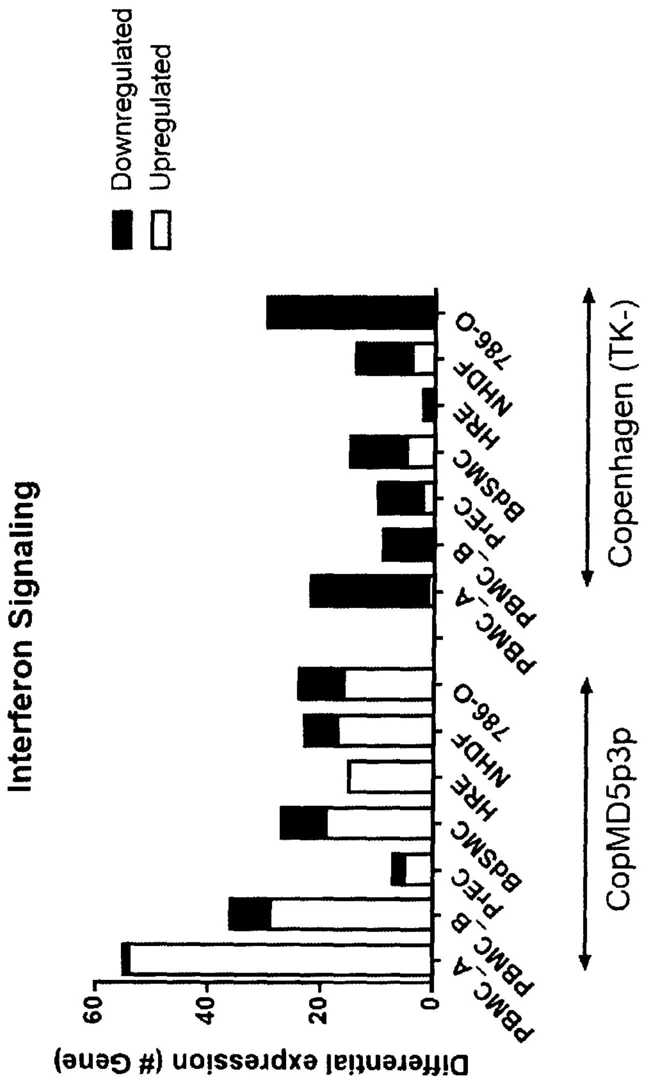
FIG. 37 shows SKV-B8R+ does not impair interferon signaling.

Interferon signaling was assessed by determining the number of genes in the interferon pathway that are upregulated (induced expression) or downregulated (repressed expression) in a variety of normal cell lines and one cancer cell line (786-O). FIG. 37 Confluent monolayers of 1 million cells were infected at an MOI of 3 ($3\times10^6$ PFU) for 18h with either SKV (CopMD5p3p-B8R+) or the parental Copenhagen virus strain having the TK gene disabled. RNA was sequenced using RNA-seq and gene expression of interferon genes was determined after read mapping a expression normalization. While the SKV (CopMD5p3p-B8R+) virus mostly induces genes in the interferon pathway the parental Copenhagen represses genes. This suggests SKV (CopMD5p3p-B8R+) is able to induce Type I Interferon signaling which is critical in viral clearance of normal cells.

Example 22—B8R Negative Vaccinia Virus Engineered to Express Flt3L, IL-12 TM and Anti-hCTLA-4

Figure 39:
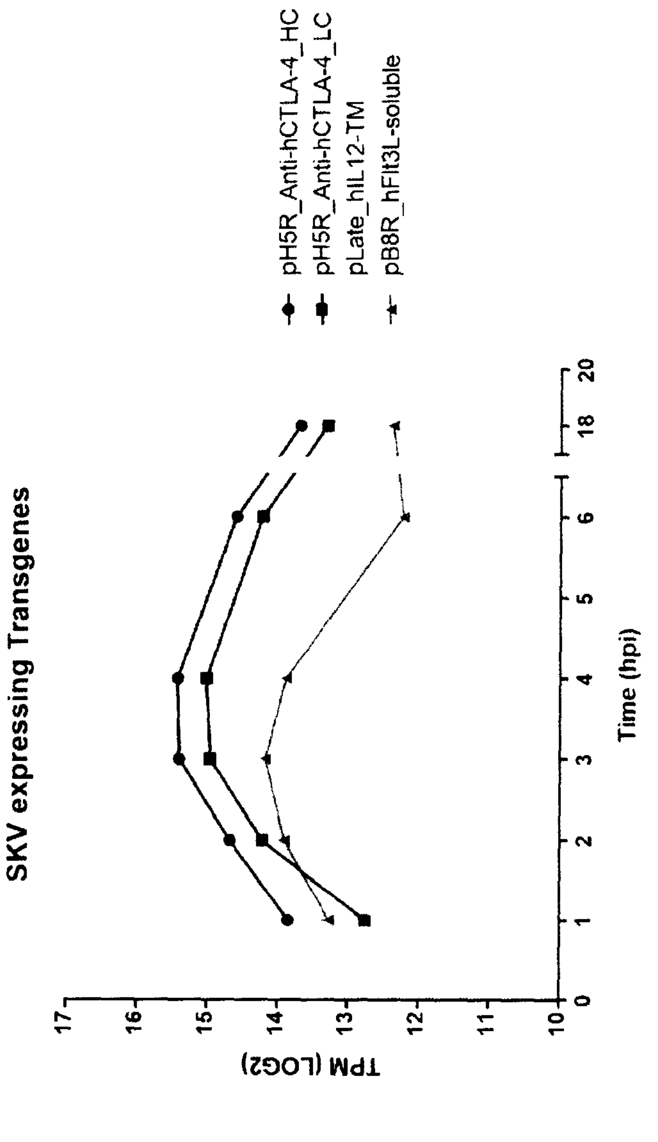
FIG. 39 shows SKV engineered to express 2 immunotherapeutuic transgenes and an antibody.

Modified vaccinia viruses containing both the CopMD5p3p and B8R deletions, as described above, were further engineered to express the immunotherapeutic transgenes. An SKV-123 virus (CopMD5p3p-B8R+-IL2TM-FLT3-antiCTLA4) expressing three transgenes was evaluated in terms of transgene expression kinetics. Confluent monolayers of 786-O human adenocarcinoma cell lines were infected with SKV-123 virus at an MOI of 3 ($3\times10^6$ pfu). RNA was sequenced using RNA-seq and gene expression of inserted transgenes were determined after read mapping after expression normalization. Transgene expression peaked at 3-4 hours after cell infection. See FIG. 39.

Figure 40:
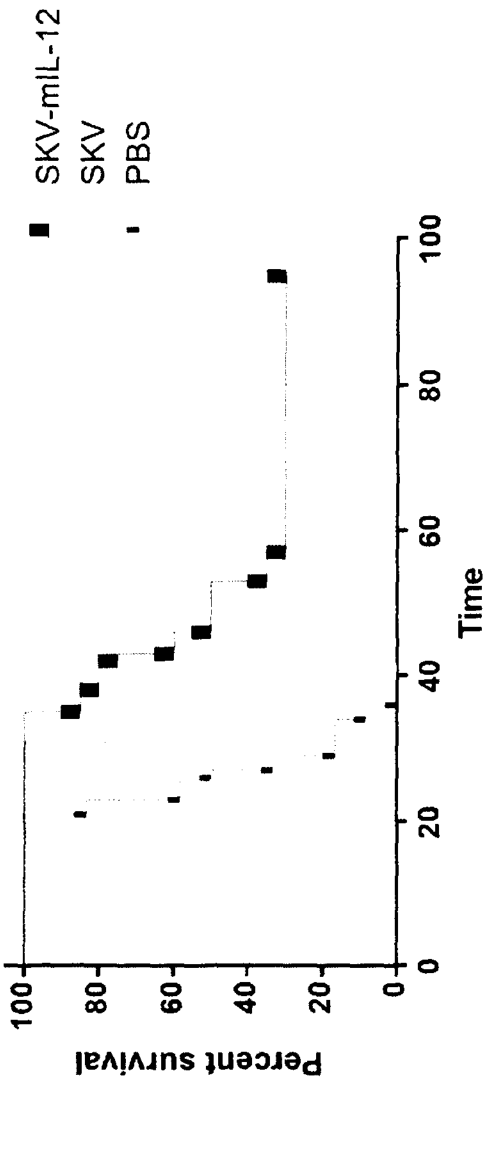
FIG. 40 shows SKV expressing murine IL-12 p35 membrane bound has greater efficacy in controlling murine tumours.

Example 23 SKV Expressing Murine IL-12 p35 Membrane Bound (SKVm-3) has Greater Efficacy in Controlling Murine Tumors The survival of mice treated with either SKV (CopMD5p3p-B8R+) or SKVm-3 (CopMD5p3p-B8R+-IL12TM) virus (expressing murine membrane bound p35 IL-12) was assessed. $5\times10^6$ CT26-LacZ cells were seeded sub cutaneously on day 0. On day 14, 16 and 18 tumours were treated at a dose of 1e7 pfu with an intratumoural injection of either SKV or SKVm-3. Although SKV virus extends survival of mice bearing CT26 colon tuomurs. SKVm-3 expression of IL-12 is able to induce remissions that lead to durable cures. See FIG. 40.

Figure 41:
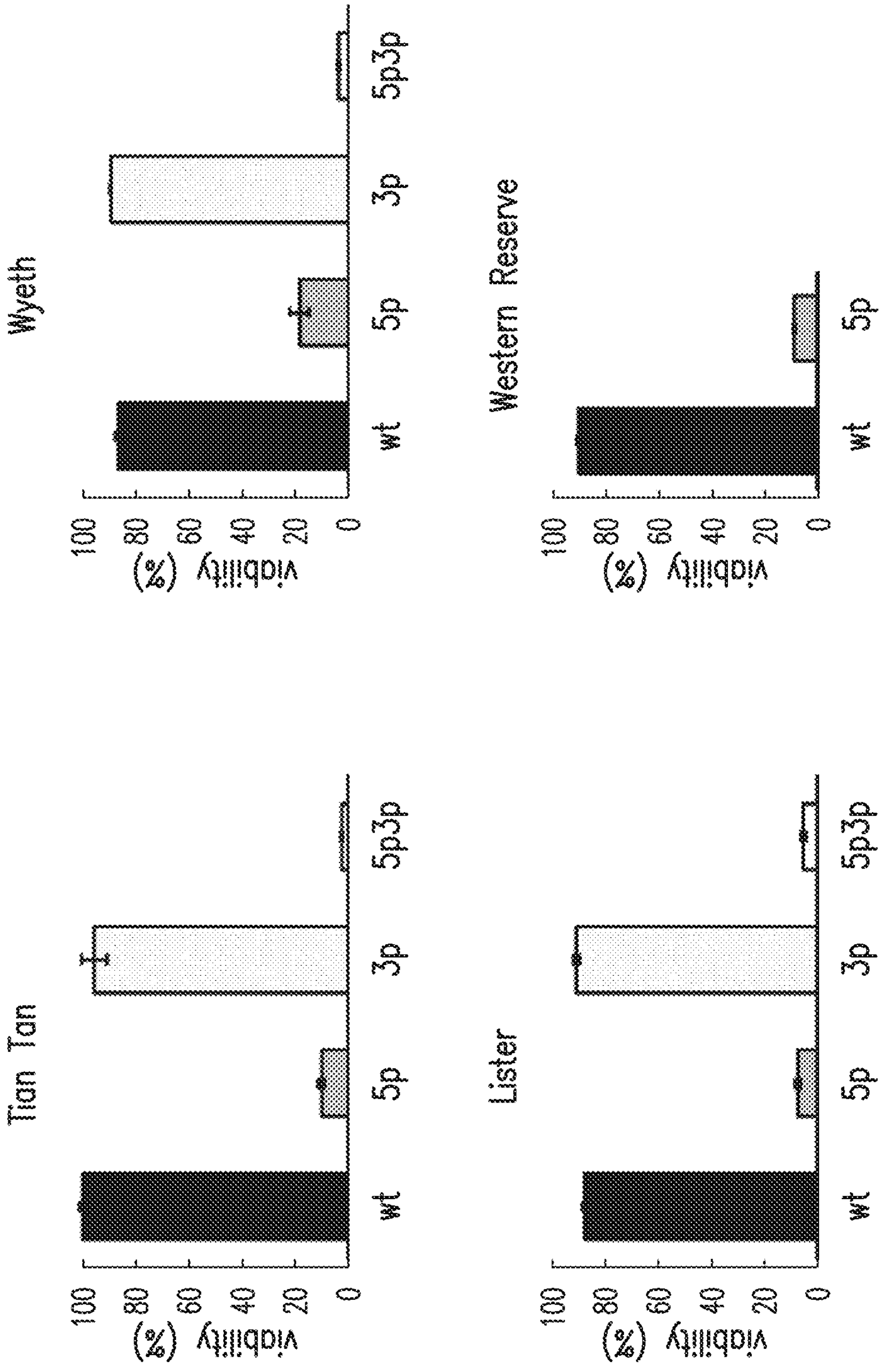
FIG. 41 shows major double deletions engineered in various vaccinia strains enhance cancer cell killing in vitro.
Figure 43:
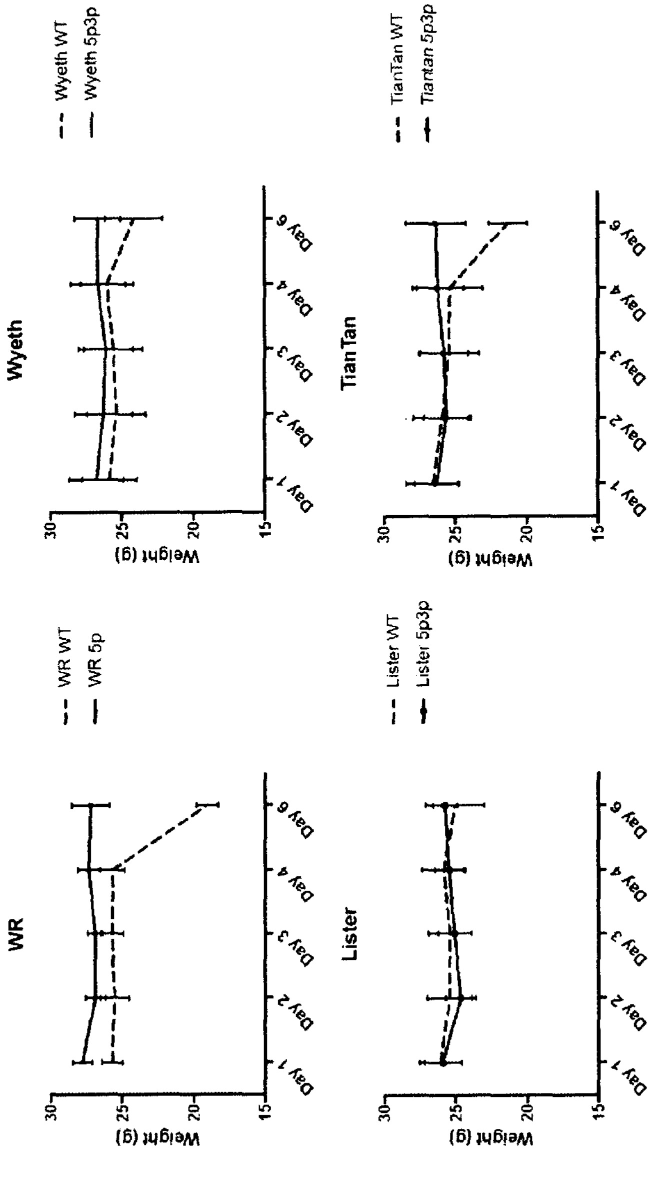
FIG. 43 shows 5p3p vaccinia strains do not induce weight loss compared to wildtype strains.

Example 24—Major Double Deletions in Engineered in Various Vaccinia Strains Enhance Cancer Cell Killing In Vitro Hela cells were infected at an MOI of 0.1 with the following strains of engineered vaccinia viruses: (1) parental wildtype virus (wt); (2) 5 prime major deleted (5p), (3) 3 prime major deleted (3p), and (4) recombined 5 prime and 3 prime major double deleted (5p3p). Cell viability was quantified by alamar blue assay 72 hours post infection. Both 5p and 5p3p major double deleted vaccinia strains are more cytotoxic in HeLa cells when compared to their parental wildtype and 3p major deleted strains. See FIG. 41. FIG. 42 depicts a summary of the major deleted Vaccinia strains, and the effect of 5p, 3p and 5p3p deletions on syncytia, cytotoxicity and replication. CD-1 nude mice were treated with $1\times10^7$ pfu via intravenously tail vein injection and measured at the indicated timepoints. 5p3p vaccinia strains did not induce weight loss compared to wildtype strains. FIG. 43. Mice were also examined for pox lesions 6 days post-injection. 5p3p vaccinia strains do not induce pox lesions compared to wildtype strains. FIG. 44.

Some Embodiments

All publications, patents, and patent applications mentioned in this specification are incorporated herein by reference to the same extent as if each independent publication or patent application was specifically and individually indicated to be incorporated by reference.

While the invention has been described in connection with specific embodiments thereof, it will be understood that it is capable of further modifications and this application is intended to cover any variations, uses, or adaptations of the invention following, in general, the principles of the invention and including such departures from the invention that come within known or customary practice within the art to which the invention pertains and may be applied to the essential features hereinbefore set forth, and follows in the scope of the claims.

Some embodiments are within the claims.

SEQUENCE LISTING (677 sequences)

SEQ ID NO: 1-22 - skipped (22 entries)

SEQ ID NO: 23 - protein, 512 aa, Vaccinia virus
MESVIFSINGEIIQVNKEIITASPYNFFKRIQDHHLKDEAIILNGINYHAFESLLDYIRWKKINITINNVEMILVAAIIIDVPPVVDLCVKTMIHNINSTNCIRMFNFSKRYGIKKLYNASMSEIINNITAVTSDPEFGKLSKDELTTILSHENVNVNHEDVTAMILLKWIHKNPNDVDIINILHPKFMTNTMRNAISLLGLTISKSTKPVTRNGIKHNIVVIKNSDYISTITHYSPRTEYWTIVGNTDRQFYNANVLHNCLYIIGGMINNRHVYSVSRVDLETKKWKTVTNMSSLKSEVSTCVNDGKLYVIGGLEFSISTGVAEYLKHGTSKWIRLPNLITPRYSGASVFVNDDIYVMGGVYTTYEKYVVLNDVECFTKNRWIKKSPMPRHHSIVYAVEYDGDIYVITGITHETRNYLYKYIVKEDKWIELYMYFNHVGKMFVCSCGDYILIIADAKYEYYPKSNTWNLFDMSTRNIEYYDMFTKDETPKCNVTHKSLPSFLSNCEKQFLQ

SEQ ID NO: 24 - protein, 224 aa, Vaccinia virus
MVKNNKISNSCRMIMSTNPNNILMRHLKNLTDDEFKCIIHRSSDFLYLSDSDYTSITKETLVSEIVEEYPDDCNKILAIIFLVLDKDIDVDIETKLKPKPAVRFAILDKMTEDIKLTDLVRHYFRYIEQDIPLGPLFKKIDSYRTRAINKYSKELGLATEYFNKYGHLMFYTLPIPYNRFFCRNSIGFLAVLSPTIGHVKAFYKFIEYVSIDDRRKFKKELMSK

SEQ ID NO: 25 - protein, 117 aa, Vaccinia virus
MRTLLIRYILWRNDNDQTYYNDDFKKLMLLDELVDDGDVCTLIKNMRMTLSDGPLLDRLNQPVNNIEDAKRMIAISAKVARDIGERSEIRWEESFTILFRMIETYFDDLMIDLYGEK

SEQ ID NO: 26 - protein, 175 aa, Vaccinia virus
MTSSAMDNNEPKVLEMVYDATILPEGSSMDPNIMDCINRHINMCIQRTYSSSIIAILNRFLTMNKDELNNTQCHIIKEFMTYEQMAIDHYGEYVNAILYQIRKRPNQHHTIDLFKKIKRTPYDTFKVDPVEFVKKVIGFVSILNKYKPVYSYVLYENVLYDEFKCFINYVETKYF

SEQ ID NO: 27 - protein, 472 aa, Vaccinia virus
MIFVIESKLLQIYRNRNRNINFYTTMDNIMSAEYYLSLYAKYNSKNLDVFRNMLQAIEPSGNNYHILHAYCGIKGLDERFVEELLHRGYSPNETDDDGNYPLHIASKINNNRIVAMLLTHGADPNACDKHNKTPLYYLSGTDDEVIERINLLVQYGAKINNSVDEEGCGPLLACTDPSERVFKKIMSIGFEARIVDKFGKNHIHRHLMSDNPKASTISWMMKLGISPSKPDHDGNTPLHIVCSKTVKNVDIIDLLLPSTDVNKQNKFGDSPLTLLIKTLSPAHLINKLLSTSNVITDQTVNICIFYDRDDVLEIINDKGKQYDSTDFKMAVEVGSIRCVKYLLDNDIICEDAMYYAVLSEYETMVDYLLFNHFSVDSVVNGHTCMSECVRLNNPVILSKLMLHNPTSETMYLTMKAIEKDKLDKSIIIPFIAYFVLMHPDFCKNRRYFTSYKRFVTDYVHEGVSYEVFDDYF

SEQ ID NO: 28 - protein, 220 aa, Vaccinia virus
MVYKLVLLFCIASLGYSVEYKNTICPPRQDYRYWYFAAELTIGVNYDINSTIIGECHMSESYIDRNANIVLTGYGLEINMTIMDTDQRFVAAAEGVGKDNKLSVLLFTTQRLDKVHHNISVTITCMEMNCGTTKYDSDLPESIHKSSSCDITINGSCVTCVNLETDPTKINPHYLHPKDKYLYHNSEYGMRGSYGVTFIDELNQCLLDIKELSYDICYRE

SEQ ID NO: 29 - protein, 284 aa, Vaccinia virus
MDLSRINTWKSKQLKSFLSSKDTFKADVHGHSALYYAIADNNVRLVCTLLNAGALKNLLENEFPLHQAATLEDTKIVKILLFSGMDDSQFDDKGNTALYYAVDSGNMQTVKLFVKKNWRLMFYGKTGWKTSFYHAVMLNDVSIVSYFLSEIPSTFDLAILLSCIHTTIKNGHVDMMILLLDYMTSTNTNNSLLFIPDIKLAIDNKDIEMLQALFKYDINIYSVNLENVLLDDAEITKMIIEKHVEYKSDSYTKDLDIVKNNKLDEIISKNKELRLMYVNCVKKN

SEQ ID NO: 30 - protein, 369 aa, Vaccinia virus
MIALLILSLTCSVSTYRLQGFTNAGIVAYKNIQDDNIVFSPFGYSFSMFMSLLPASGNTRIELLKTMDLRKRDLGPAFTELISGLAKLKTSKYTYTDLTYQSFVDNTVCIKPLYYQQYHRFGLYRLNFRRDAVNKINSIVERRSGMSNVVDSNMLDNNTLWAIINTIYFKGTWQYPFDITKTRNASFTNKYGTKTVPMMNVVTKLQGNTITIDDEEYDMVRLPYKDANISMYLAIGDNMTHFTDSITAAKLDYWSFQLGNKVYNLKLPKFSIENKRDIKSIAEMMAPSMFNPDNASFKHMTRDPLYIYKMFQNAKIDVDEQGTVAEASTIMVATARSSPEKLEFNTPFVFIIRHDITGFILFMGKVESP

SEQ ID NO: 31 - protein, 81 aa, Vaccinia virus
MGHIITYCQVHTNISILIRKAHHIIFFVIDCDCISLQFSNYVHHGNRFRTVLISKTSIACFSDIKRILPCTFKIYSINDCP

SEQ ID NO: 32 - protein, 79 aa, Vaccinia virus
MGTVFVPYLLVKLALRVLVISNGYCHVPLKYIVLMIAHRVLLSSILESTTLDIPDLRSTIELILLTASRLKFNLYRPNL

SEQ ID NO: 33 - protein, 88 aa, Vaccinia virus
MLAFCYSLPNAGDVIKGRVYEKDYALYIYLFDYPHSEAILAESVKMHMDRYVEYRDKLVGKTVKVKVIRVDYTKGYIDVNYKRMCRHQ

SEQ ID NO: 34 - protein, 424 aa, Vaccinia virus
MNPDNTIAVITETIPIGMQFDKVYLSTFNMWREILSNTTKTLDISSFYWSLSDEVGTNFGTIILNEIVQLPKRGVRVRVAVNKSNKPLKDVERLQMAGVEVRYIDITNILGGVLHTKFWISDNTHIYLGSANMDWRSLTQVKELGIAIFNNRNLAADLTQIFEVYWYLGVNNLPYNWKNFYPSYYNTDHPLSINVSGVPHSVFIASAPQQLCTMERTNDLTALLSCIRNASKFVYVSVMNFIPIIYSKAGKILFWPYIEDELRRSAIDRQVSVKLLISCWQRSSFIMRNFLRSIAMLKSKNIDIEVKLFIVPDADPPIPYSRVNHAKYMVTDKTAYIGTSNWTGNYFTDTCGASINITPDDGLGLRQQLEDIFMRDWNSKYSYELYDTSPTKRCKLLKNMKQCTNDIYCDEIQPEKEIPEYSLE

SEQ ID NO: 35 - protein, 135 aa, Vaccinia virus
MGATISILASYDNPNLFTAMILMSPLVNADAVSRLNLLAAKLMGTITPNAPVGKLCPESVSRDMDKVYKYQYDPLINHEKIKAGFASQVLKATNKVRKIISKINTPRLSYSREQTMRLVMFQVHIISCNMQIVIE

SEQ ID NO: 36 - protein, 81 aa, Vaccinia virus
MSANCMFNLDNDYIYWKPITYPKALVFISHGAGKHSGRYDELAENISSLGILVFSHDHIGHGRSNGEKMMIDDFGTARGNY

SEQ ID NO: 37 - protein, 149 aa, Vaccinia virus
MATKLDYEDAVFYFVDDDKICSRDSIIDLIDEYITWRNHVIVFNKDITSCGRLYKELMKFDDVAIRYYGIDKINEIVEAMSEGDHYINFTKVHDQESLFATIGICAKITEHWGYKKISESRFQSLGNITDLMTDDNINILILFLEKKLN

SEQ ID NO: 38 - protein, 226 aa, Vaccinia virus
MLSMFMCNNIVDYVDDIDNGIVQDIEDEASNNVDHDYVYPLPENMVYRFDKSTNILDYLSTERDHVMMAVRYYMSKQRLDDLYRQLPTKTRSYIDIINIYCDKVSNDYNRDMNIMYDMASTKSFTVYDINNEVNTILMDNKGLGVRLATISFITELGRRCMNPVKTIKMFTLLSHTICDDCFVDYITDISPPDNTIPNTSTREYLKLIGITAIMFATYKTLKYMIG

SEQ ID NO: 39 - protein, 147 aa, Vaccinia virus
MFNMNINSPVRFVKETNRAKSPTRQSPGAAGYDLYSAYDYTIPPGERQLIKTDISMSMPKICYGRIAPRSGLSLKGIDIGGGVIDEDYRGNIGVILINNGKCTFNVNTGDRIAQLIYQRIYYPELEEVQSLDSTNRGDQGFGSTGLR

SEQ ID NO: 40 - protein, 480 aa, Vaccinia virus
MPIFVNTVYCKNILALSMTKKFKTIIDAIGGNIIVNSTILKKLSPYFRTHLRQKYTKNKDPVTRVCLDLDIHSLTSIVIYSYTGKVYIDSHNVVNLLRASILTSVEFIIYTCINFILRDFRKEYCVECYMMGIEYGLSNLLCHTKNFIAKHFLELEDDIIDNFDYLSMKLILESDELNVPDEDYVVDFVIKWYIKRRNKLGNLLLLIKNVIRSNYLSPRGINNVKWILDCTKIFHCDKQPRKSYKYPFIEYPMNMDQIIDIFHMCTSTHVGEVVYLIGGWMNNEIHNNAIAVNYISNNWIPIPPMNSPRLYATGIPANNKLYVVGGLPNPTSVERWFHGDAAWVNMPSLLKPRCNPAVASINNVIYVMGGHSETDTTTEYLLPNHDQWQFGPSTYYPHYKSCALVFGRRLFLVGRNAEFYCESSNTWTLIDDPIYPRDNPELIIVDNKLLLIGGFYRGSYIDTIEVYNHHTYSWNIWDGK

SEQ ID NO: 41 - protein, 512 aa, Vaccinia virus; identical to SEQ ID NO: 23

SEQ ID NO: 42 - protein, 229 aa, Vaccinia virus
MVKNNKIQKNKISNSCRMIMSTDPNNILMRHLKNLTDDEFKCIIHRSSDFLYLSDSDYTSITKETLVSEIVEEYPDDCNKILAIIFLVLDKDIDVDIKTKLKPKPAVRFAILDKMTEDIKLTDLVRHYFRYIEQDIPLGPLFKKIDSYRTRAINKYSKELGLATEYFNKYGHLMFYTLPIPYNRFFCRNSIGFLAVLSPTIGHVKAFYKFIEYVSIDDRRKFKKELMSK

SEQ ID NO: 43 - protein, 117 aa, Vaccinia virus
MRTLLIRYILWRNDNDQTYYNDNFKKLMLLDELVDDGDVCTLIKNMRMTLSDGPLLDRLNQPVNNIEDAKRMIAISAKVARDIGERSEIRWEESFTILFRMIETYFDDLMIDLYGEK

SEQ ID NO: 44 - protein, 175 aa, Vaccinia virus
MTSSAMDNNEPKVLEMVYDATILPEGSSMDPNIMDCINRHINMCIQRTYSSSIIAILDRFLMMNKDELNNTQCHIIKEFMTYEQMAIDHYGGYVNAILYQIRKRPNQHHTIDLFKRIKRTRYDTFKVDPVEFVKKVIGFVSILNKYKPVYSYVLYENVLYDEFKCFINYVETKYF

SEQ ID NO: 45 - protein, 472 aa, Vaccinia virus
MIFVIESKLLQIYRNRNRNINFYTTMDNIMSAEYYLSLYAKYNSKNLDVFRNMLQAIEPSGNNYHILHAYCGIKGLDERFVEELLHRGYSPNETDDDGNYPLHIASKINNNRIVAMLLTHGADPNACDKHNKTPLYYLSGTDDEVIERINLLVQYGAKINNSVDEEGCGPLLACTDPSERVFKKIMSIGFEARIVDKFGKNHIHRHLMSDNPKASTISWMMKLGISPSKPDHDGNTPLHIVCSKTVKNVDIIDLLLPSTDVNKQNKFGDSPLTLLIKTLSPAHLINKLLSTSNVITDQTVNICIFYDRDDVLEIINDKGKQYDSTDFKMAVEVGSIRCVKYLLDNDIICEDAMYYAVLSEYETMVDYLLFNHFSVDFVVNGHTCMSECVRLNNPVILSKLMLHNPTSETMYLTMKAIEKDRLDKSIIIPFIAYFVLMHPDFCKNRRYFTSYKRFVTDYVHEGVSYEVFDDYF

SEQ ID NO: 46 - protein, 220 aa, Vaccinia virus
MVYKLVLLFCIASLGYSVEYKNTICPPRQDYRYWYFAAELTIGVNYDINSTIIGECHMSESYIDRNANIVLTGYGLEINMTIMDTDQRFVAAAEGVGKDNKLSVLLFTTQRLDKVHHNISVTITCMEMNCGTTKYDSDLPESIHKSSSCDITINGSCVTCVNLETDPTKINPHYLHPKDKYLYHNSEYSMRGSYGVTFIDELNQCLLDIKELSYDICYRE

SEQ ID NO: 47 - protein, 284 aa, Vaccinia virus
MDLSRINTWKSKQLKSFLSSKDAFKADVHGHSALYYAIADNNVRLVCTLLNAGALKNLLENEFPLHQAATLEDTKIVKILLFSGLDDSQFDDKGNTALYYAVDSGNMQTVKLFVKKNWRLMFYGKTGWKTSFYHAVMLNDVSIVSYFLSEIPSTFDLAILLSCIHITIKNGHVDMMILLLDYMTSTNTNNSLLFIPDIKLAIDNKDIEMLQALFKYDINIYSANLENVLLDDAEIAKMIIEKHVEYKSDSYTKDLDIVKNNKLDEIISKNKELRLMYVNCVKKN

SEQ ID NO: 48 - protein, 369 aa, Vaccinia virus
MIALLILSLTCSVSTYRLQGFTNAGIVAYKNIQDDNIVFSPFGYSFSMFMSLLPASGNTRIELLKTMDLRKRDLGPAFTELISGLAKLKTSKYTYTDLTYQSFVDNTVCIKPSYYQQYHRFGLYRLNFRRDAVNKINSIVERRSGMSNVVDSNMLDNNTLWAIINTIYFKGIWQYPFDITKTRNASFTNKYGTKTVPMMNVVTKLQGNTITIDDEEYDMVRLPYKDANISMYLAIGDNMTHFTDSITAAKLDYWSFQLGNKVYNLKLPKFSIENKRDIKSIAEMMAPSMFNPDNASFKHMTRDPLYIYKMFQNAKIDVDEQGTVAEASTIMVATARSSPEKLEFNTPFVFIIRHDITGFILFMGKVESP

SEQ ID NO: 49 - protein, 88 aa, Vaccinia virus
MLAFCYSLPNAGDVIKGRVYEKDYALYIYLFDYPHFEAILAESVKMHMDRYVEYRDKLVGKTVKVKVIRVDYTKGYIDVNYKRMCRHQ

SEQ ID NO: 50 - protein, 424 aa, Vaccinia virus
MNPDNTIAVITETIPIGMQFDKVYLSTFNMWREILSNTTKTLDISSFYWSLSDEVGTNFGTIILNKIVQLPKRGVRVRVAVNKSNKPLKDVERLQMAGVEVRYIDITNILGGVLHTKFWISDNTHIYLGSANMDWRSLTQVKELGIAIFNNRNLAADLTQIFEVYWYLGVNNLPYNWKNFYPSYYNTDHPLSINVSGVPHSVFIASAPQQLCTMERTNDLTALLSCIRNASKFVYVSVMNFIPIIYSKAGNILFWPYIEDELRRAAIDRQVSVKLLISCWQRSSFIMRNFLRSIAMLKSKNINIEVKLFIVPDADPPIPYSRVNHAKYMVTDKTAYIGTSNWTGNYFTDTCGASINITPDDGLGLRQQLEDIFMRDWNSKYSYELYDTSPTKRCRLLKNMKQCTNDIYCDEIQPEKEIPEYSLE

SEQ ID NO: 51 - protein, 44 aa, Vaccinia virus
MQHANCNREIKIYEGAKHHLHKETDEVKKSVMKEIETWIFNRVK

SEQ ID NO: 52 - protein, 134 aa, Vaccinia virus
MTLVQHVVTIKSTYWVIPWELASYDNPNLFTAMILMSPLVNADAVSKLNLLAAKLMGTITLNAPVGKLCPESVSRDMDKVYKYQYDPLINHEKIKAGFASQVLKATNKVRKIISKINTPRLSYSREQTIRLAMF

SEQ ID NO: 53 - protein, 81 aa, Vaccinia virus; identical to SEQ ID NO: 36

SEQ ID NO: 54 - protein, 149 aa, Vaccinia virus; identical to SEQ ID NO: 37

SEQ ID NO: 55 - protein, 226 aa, Vaccinia virus
MLSMFMCNNIVDYVDDIDNGIVQDIEDEASNNVDHDYVYPLPENMVYRFDKSTNILDYLSTERDHVMMAVRYYMSKQRLDDLYRQLPTKTRSYIDIINIYCDKVSNDYNRDMNIMYDMASTKSFTVYDINNEVNTILMDNKGLGVRLATISFITELGRRCMNPVETIKMFTLLSHTICDDYFVDYITDISPPDNTIPNTSTREYLKLIGITAIMFATYKTLKYMIG

SEQ ID NO: 56 - protein, 147 aa, Vaccinia virus
MFNMNINSPVRFVKETNRAKSPTRQSPYAAGYDLYSAYDYTIPPGERQLIKTDISMSMPKFCYGRIAPRSGLSLKGIDIGGGVIDEDYRGNIGVILINNGKCTFNVNTGDRIAQLIYQRIYYPELEEVQSLDSTNRGDQGFGSTGLR

SEQ ID NO: 57 - protein, 480 aa, Vaccinia virus
MPIFVNTVYCKNILALSMTKKFKTIIDAIGGNIIVNSTILKKLSPYFRTHLRQKYTKNKDPVTWVCLDLDIHSLTSIVIYSYTGKVYIDSHNVVNLLRASILTSVEFIIYTCINFILRDFRKEYCVECYMMGIEYGLSNLLCHTKNFIAKHFLELEDDIIDNFDYLSMKLILESDELNVPDEDYVVDFVIKWYIKRRNKLGNLLLLIKNVIRSNYLSPRGINNVKWILDCTKIFHCDKQPRKSYKYPFIEYPMNMDQIIDIFHMCTSTHVGEVVYLIGGWMNNEIHNNAIAVNYISNNWIPIPPMNSPRLYASGIPANNKLYVVGGLPNPTSVERWFHGDAAWVNMPSLLKPRCNPAVASINNVIYVMGGHSETDTTTEYLLPNHDQWQFGPSTYYPHYKSCALVFGRRLFLVGRNAEFYCESSNTWTLIDDPIYPRDNPELIIVDNKLLLIGGFYRESYIDTIEVYNHHTYSWNIWDGK

SEQ ID NO: 58 - protein, 512 aa, Vaccinia virus
MESVIFSINGEIIQVNKEIITASPYNFFKRIQDHHLKDEAIILNGINYHAFESLLDYIRWKKINITINNVEMILVAAIIIDVPPVVDLCVKTMIHNINSTNCIRMFNFSKQYGIKKLYNASMSEIINNITAVTSDPEFGKLSKDELTTILSHEDVNVNHEDVTAMILLKWIHKNPNDVDIINILHPKFMTNTMRNAISLLGLTISKSTKPVTRNGIKHNIVVIKNSDYISTITHYSPRTEYWTIVGNTDRQFYNANVLHNCLYIIGGMINNRHVYSVSRVDLETKKWKTVTNMSSLKSEVSTCVNNGKLYVIGGLEFSISTGVAEYLKHGTSKWIRLPNLITPRYSGASVFVNDDIYVMGGVYTTYEKYVVLNDVECFTKNRWIKKSPMPRHHSIVYAVEYDGDIYVITGITHETRNYLYKYIVKEDKWIELYMYFNHVGKMFVCSCGDYILIIADAKYEYYPKSNTWNLFDMSTRNIEYYDMFTKDETPKCNVTHKSLPSFLSNCEKQFLQ

SEQ ID NO: 59 - protein, 224 aa, Vaccinia virus
MVKNNKISNSCRMIMSTDPNNILMRHLKNLTDDEFKCIIHRSSDFLYLSDSDYTSITKETLVSEIVEEYPDDCNKILAIIFLVLDKDIDVDIKTKLKPKPAVRFAILDKMTEDIKLTDLVRHYFRYIEQDIPLGPLFKKIDSYRTRAINKYSKELGLATEYFNKYGHLMFYTLPIPYNRFFCRNSIGFLAVLSPTIGHVKAFYKFIEYVSIDDRRKFKKELMSK

SEQ ID NO: 60 - protein, 117 aa, Vaccinia virus; identical to SEQ ID NO: 25

SEQ ID NO: 61 - protein, 79 aa, Vaccinia virus
MTSSAMDNNEPKVLEMVYDATILPEGSSMDPYIMDCINRHINMCIQRTYSSSIIAILDRFLMMNKDELNNTQCHIIKNL

SEQ ID NO: 62 - protein, 472 aa, Vaccinia virus
MIFVIESKLLQIYRNRNRNINFYTTMDNIMSAEYYLSLYAKYNSKNLDVFRNMLQAIEPSGNNYHILHAYCGIKGLDERFVEELLHRGYSPNETDDDGNYPLHIASKINNNRIVAMLLTHGADPNACDKHNKTPLYYLSGTDDEVIERINLLVQYGAKINNSVDEEGCGPLLACTDPSERVFKKIMSIGFEARIVDKFGKNHIHRHLMSDNPKASTISWMMKLGISPSKPDHDGNTPLHIVCSKTVKNVDIIDLLLPSTDVNKQNKFGDSPLTLLIKTLSPAHLINKLLSTSNVITDQTVNICIFYDRDDVLEIINDKGKQYDSTDFKMAVEVGSIRCVKYLLDNDIICEDAMYYAVLSEYETMVDYLLFNHFSVDFVVNGHTCMSECVRLNNPVILSKLMLHNLTSETMYLTMKAIEKDRLDKSIIIPFIAYFVLMHPDFCKNRRYFTSYKRFVTDYVHEGVSYEVFDDYF

SEQ ID NO: 63 - protein, 196 aa, Vaccinia virus
MSSSTRLPVLVLAAELTIGVNYDINSTIIGECHMSESYIDRNANIVLTGYGLEINMTIMDTDQRFVAAAEGVGKDNKLSVLLFTTQRLDKVHHNISVTITCMEMNCGTTKYDSDLPESIHKSSSCDITINGSCVTCVNLETDPTKINPHYLHPKDKYLYHNSEYGMRGSYGVTFIDELNQCLLDIKELSYDICYRE

SEQ ID NO: 64 - protein, 76 aa, Vaccinia virus
MLQALFKYDINIYSANLENVLLDDAEIAKMIIEKHVEYKSDSYTKDLDIVKNNKLDEIISKNKELRLMYVNCVKKN

SEQ ID NO: 65 - protein, 189 aa, Vaccinia virus
MDLSRINTWKSKQLKSFLSSKDTFKADVHGHSALYYAIADNNVRLVCTLLNSGALKNLLENEFPLHQAATLEDTKIVKILLFSGLDDSQFDDKGNTALYYAVDSGNMQTVKLFVKKNWRLMFYGKTGWKTSFYHAVMLNDVSIVSYFLSEIPSTFDLAILLSCIHITIKNGHVDMMILLLDYMTVDKHQ

SEQ ID NO: 66 - protein, 368 aa, Vaccinia virus
MIALLILSLACSASAYRLQGFTNAGIVAYKNIQDDNIVFSPFGYSFSMFMSLLPASGNTRIELLKTMDLRKRDLGPAFTELISGLAKLKTSKYTYTDLTYQSFVDNTVCIKPSYYQQYHRFGLYRLNFRRDAVNKINSIVERRSGMSNVVDSNMLDNNTLWAIINTIYFKGTWQYPFDITKTRNASFTNKYGTKTVPMMNVVTKLQGNTITIDDEEYDMVRLPYKDANISMYLAIGDNMTHFTDSITAAKDYWSFQLGNKVYNLKLPKFSIENKRDIKSIAEMMAPSMFNPDNASFKHMTRDPLYIYKMFQNAKIDVDEQGTVAEASTIMVATARSSPEELEFNTPFVFIIRHDITGFILFMGKVESP

SEQ ID NO: 67 - protein, 81 aa, Vaccinia virus
MGHIITYCQVHTNISILIRKAYHIIFFVIDCDCISLQFSNYVHHGNRFRTVLISKTSIACFSDIKRILPCTFKIYSINDCP

SEQ ID NO: 68 - protein, 88 aa, Vaccinia virus; identical to SEQ ID NO: 33

SEQ ID NO: 69 - protein, 134 aa, Vaccinia virus; identical to SEQ ID NO: 52

SEQ ID NO: 70 - protein, 149 aa, Vaccinia virus; identical to SEQ ID NO: 37

SEQ ID NO: 71 - protein, 226 aa, Vaccinia virus
MLSMFMCNNIVDYVDDIDNGIVQDIEDEASNNVDRDYVYPLPENMVYRFDKSTNILDYLSTERDHVMMAVRYYMSKQRLDDLYRQLPTKTRSYIDIINIYCDKVSNDYNRDMNIMYDMASTKSFTVYDINNEVNTILMDNKGLGVRLATISFITELGRRCMNPVKTIKMFTLLSHTICDDCFVDYITDISPPDNTIPNTSTREYLKLIGITAIMFATYKTLKYMIG

SEQ ID NO: 72 - protein, 147 aa, Vaccinia virus
MFNMNINSPVRFVKETNRAKSPTRQSPGAAGYDLYSAYDYTIPPGERQLIKTDISMSMPKICYGRIAPRSGLSLKGIDIGGGVIDEDYRGNIGVILINNGKCTFNVNTGDRIAQLIYQRIYYPELEEVQSLDSTDRGDQGFGSTGLR

SEQ ID NO: 73 - protein, 480 aa, Vaccinia virus
MPIFVNTVYCKNILALSMTKKFKTIIDAIGGNIIVNSTILKKLSPYFRTHLRQKYTKNKDPVTRVCLDLDIHSLTSIVIYSYTGKVYIDSHNVVNLLRASILTSVEFIIYTCINFILRDFRKEYCVECYMMGIEYGLSNLLCHTKNFIAKHFLELEDDIIDNFDYLSMKLILESDELNVPDEDYVVDFVIKWYIKRRNKLGNLLLLIKNVIRSNYLSPRGINNVKWILDCTKIFHCDKQPRKSYKYPFIEYPMNMDQIIDIFHMCTSTHVGEVVYLIGGWMNNEIHNNAIAVNYISNNWIPIPPMNSPRLYASGIPANNKLYVVGGLPNPTSVERWFHGDAAWVNMPSLLKPRCNPAVASINNVIYVMGGHSETDTTTEYLLPNHDQWQFGPSTYYPHYKSCALVFGRRLFLVGRNAEFYCESSNTWTLIDDPIYPRDNPELIIVDNKLLLIGGFYRESYIDTIEVYNHHTYSWNIWDGK

SEQ ID NO: 74 - protein, 506 aa, Vaccinia virus
MESVTFSINGEIIQVNKEIITASPYNFFKRIQEHHINDEVIILNGINYHAFESLLDYMRWKKINITINNVEMILVAAVIIDVTPVVDLCVKTMIHNINSTNCIRMFNFSKRYGIKKLYNASMSEIINNITAVTSDPEFGKLSKDELTTILSHEDVNVNHEDVTAMILLKWIHKNPNDVDIINILHPKFMTNTMRNAISLLGLTISKSTKPVTRNGIKHNIVVIKNSDYISTITHYSPRTEYWTIVGNTDRQFYNANVLHNCLYIIGGMINNRHVYSVSRVDLETKKWKTVTNMSSLKSEVSTCVNNGKLYVIGGLEFSISTGVAEYLKHGTSKWIRLPNLITPRYSGASVFVNDDIYVMGGVYTTYEKYVVLNDVECFTKNRWIKKSPMPRHHSIVYAVEYDGDIYAITGITHETRNYLYKYIVKEDKWIELYMYFNHVGKMFVCSCGDYILIIADAKYEYYPKSNTWNLFDMSTRNIEYYDMFTKDETHKSLPSFLSNCEKQFLQ

SEQ ID NO: 75 - protein, 224 aa, Vaccinia virus
MVKNNKISNSCRMIMSTNPNNILMRHLKNLTDDEFKCIIHRSSDFLYLSDRDYTSITKETLVSEIVEEYPDDCNKILAIIFLVLDKDIDVDIKTKLKPKPAVRFAILDKMTEDIKLTDLVRHYFRYIEQDIPLGPLFKKIDSYRTRAINKYSKELGLATEYFNKYGHLMFYTLPIPYNRFFCRNSIGFLAVLSPTIGHVKAFYKFIEYVSIDDRRKFKKELMSK

SEQ ID NO: 76 - protein, 117 aa, Vaccinia virus; identical to SEQ ID NO: 25

SEQ ID NO: 77 - protein, 175 aa, Vaccinia virus
MTSSAMDNNEPKVLEMVYDATILPEGSSMDPNIIDCINRHINMCIQRTYSSSIIAILDRFLTMNKDELNNTQCHIIKEFMTYEQMAIDHYGGYVNAILYQIRKRPNQHHTIDLFKKIKRTRYDTFKVDPVEFVKKVIGFVSILNKYKPVYSYVLYENVLYDEFKCFIDYVETKYF

SEQ ID NO: 78 - protein, 72 aa, Vaccinia virus
MLHNPTSETMYLTMNAIKKDKLDKSIIIPFIAYFVLMHPDFCKNRRYFTSYKRFVTDYVHEGVSYEVFDDYF

SEQ ID NO: 79 - protein, 214 aa, Vaccinia virus
MSIGFEARIVDKFGKNHIHRHLMSDNPKASTISWMMKLGISPSKPDHDGNTPLHIVCSKTVKYVDIIDLLLPSTDVNKQNKFGDSPLTLLIKTLSLAHLINKLLSTSNVITDQTVNICIFYDRDDVLEIINDKGKQYDFKMAVEVGSIKCVKYLLDNDIICEDAMYYAVLSEYKTMVDYLLFNHFSVDSVVNGHTCMSECVKLNNRHFIEADVT

SEQ ID NO: 80 - protein, 161 aa, Vaccinia virus
MIFVIESKLLQIYRNRNRNINFYTTMDNIMSAEYYLSLYAKYNSKNLDVFRNMLQAIEPSGNNYHILHAYCGIKGLDERFVEELLHRGYSPNETDDDGNYPLHIASKINNNRIVAMLLTHGADPNACDKHNKTPLYYLSGTDDEVIERINLLVQYGAKINN

SEQ ID NO: 81 - protein, 220 aa, Vaccinia virus; identical to SEQ ID NO: 28

SEQ ID NO: 82 - protein, 284 aa, Vaccinia virus
MDLSRINTWKSKQLKSFLSSKDTFKADVHGHSALYYAIADNNVRLVCTLLNAGALKNLLENEFPLHQAATLEDTKIVKILLFSGLDDSQFDDKGNTALYYAVDSGNMQTVKLFVKKNWRLMFYGKTGWKTSFYHAVMLNDVSIVSYFLSEIPSTFDLAILLSCIHITIKNGHVDMMILLLDYMTSTNTNNSLLFIPDIKLAIDNKDIEMLQALFKYDINIYSANLENVLLDDAEIAKMIIEKHVEYKSDSYTKDLDIVKNNKLDEIISKNKELRLMYVNCVKKN

SEQ ID NO: 83 - protein, 364 aa, Vaccinia virus
MIALLILSLTCSVSTYRLQGFTNAGIVAYKNIQDDNIVFSPFGYSFSMFMSLLPASGNTRIELLKTMDLRKRDLGPAFTELISGLAKLKTSKYTYTDLTYQSFVDNTVCIKPSYYQQYHRLNFRRDAVNKINSIVERRSGMSNVVDSNMLDNNTLWAIINTIYFKGIWQYPFDITKTRNASFTNKYGTKTVPMMNVVTKLQGNTITIDDKEYDMVRLPYKDANISMYLAIGDNMTHFTDSITAAKLDYWSFQLGNKVYNLKLPKFSIENKRDIKSIAEMMAPSMFNPDNASFKHMTRDPLYIYKMFQNAKIDVDEQGTVAEASTIMVATARSSPEKLEFNTPFVFIIRHDITGFILFMGKVESP

SEQ ID NO: 84 - protein, 88 aa, Vaccinia virus
MLAFCYSLPNAGDVIKGRVYENDYALYIYLFDYPHFEAILAESVKMHMDRYVEYRDKLVGKTVKVKVIRVDYTKGYIDVNYKRMCRHQ

SEQ ID NO: 85 - protein, 424 aa, Vaccinia virus
MNPDNTIAVITETIPIGMQFDKVYLSTFNMWREILSNTTKTLDISSFYWSLSDEVGTNFGTIILNEIVQLPKRGVRVRVAVNKSNKPLKDVERLQMAGVEVRYIDITNILGGVLHTKFWISDNTHIYLGSANMDWRSLTQVKELGIAIFNNRNLAADLTQIFEVYWYLGVNNLPYNWKNFYPSYYNTDHPLSINVSGVPHSVFIASAPQQLCTMERTNDLTALLSCIRNASKFVYVSVMNFIPIIYSKAGKILFWPYIEDELRRSAIDRQVSVKLLISCWQRSSFIMRNFLRSIAMLKSKNINIEVKLFIVPDADPPIPYSRVNHAKYMVTDKTAYIGTSNWTGNYFTDTCGASINITPDDGLGLRQQLEDIFMRDWNSKYSYELYDTSPTKRCKLLKNMKQCTNDIYCDEIQPEKEIPEYSLE

SEQ ID NO: 86 - protein, 171 aa, Vaccinia virus
MGATISILASYDNPNLFTAMILMSPLVNADAVSKLNLLAAKLMGTITPNAPVGKLCPESVSRDMDKVYKYQYDPLINHEKIKAGFASQVLKATNKVRKIISKINTPPTLILQGTNNEISDVLGAYYFMQHANCNREIKIYEGAKHHLHKETDEVKKSVMKEIETWIFNRVK

SEQ ID NO: 87 - protein, 81 aa, Vaccinia virus; identical to SEQ ID NO: 36

SEQ ID NO: 88 - protein, 149 aa, Vaccinia virus; identical to SEQ ID NO: 37

SEQ ID NO: 89 - protein, 226 aa, Vaccinia virus
MLSMFMCNNIVDYVDDIDNGIVQDIEDEASNNVDHDYVYPLPENMVYRFDKSTNILDYLSTERDHVMMAVRYYMSKQRLDDLYRQLPTKTRSYIDIINIYCDKVSNDYNRDMNIMYDMASTKSFTVYDINNEVNTILMDNKGLGVRLATISFITKLGRRCMNPVKTIKMFTLLSHTICDDCFVDYITDISPPDNTIPNTSTREYLKLIGITAIMFATYKTLKYMIG

SEQ ID NO: 90 - protein, 147 aa, Vaccinia virus; identical to SEQ ID NO: 39

SEQ ID NO: 91 - protein, 480 aa, Vaccinia virus; identical to SEQ ID NO: 73

SEQ ID NO: 92 - protein, 512 aa, Vaccinia virus
MESVIFSINGEIIQVNKEIITASPYNFFKRIQDHHLKDEAIILNGINYHAFESLLDYMRWKKINITINNVEMILVAAIIIDVPPVVDLCVKTMIHNINFTNCIRMFNFSKRYGIKKLYNASMSEIINNITAVTSDPEFGKLSKDELTTILSHEDVNVNHEDVTAMILLKWIHKNPNDVDIINILHPKFMTNTMRNAISLLGLTISKSTKPVTRNGIKHNIVVIKNSDYISTITHYSPRTEYWTIVGNTDRQFYNANVLHNCLYIIGGMINNRHVYSVSRVDLKTKKWKTVTNMSSLKSEVSTCVNDGKLYVIGGLEFSISTGVAEYLKHGTSKWIRLPNLITPRYSGASVFVNDDIYVMGGVYTTYEKYVVLNDVECFTKNRWIKKSPMPRHHSIVYAVEYDGDIYVITGITHETRNYLYKYIVKEDKWIELYMYFNHVGKMFVCSCGDYILIIADAKYEYYPKSNTWNLFDMSTRNIEYYDMFTKDETPKCNVTHKSLPSFLSNCEKQFLQ

SEQ ID NO: 93 - protein, 224 aa, Vaccinia virus
MVKNNKISNSCRMIMSTNPNNILMRHLKNLTDDEFKCIIHRSSDFLYLSDSDYTSITKETLVSEIVEEYPDDCNKILAIIFLVLDKDIDVDIETKLKPKPAVRFAILDKMTADIKLTDLVRHYFRYIEQDIPLGPLFKKIDSYRTRAINKYSKELGLATEYFNKYGHLMFYTLPIPYNRFFCRNSIGFLAVLSPTIGHVKAFYKFIEYVSIDDRRKFKKELMSK

SEQ ID NO: 94 - protein, 117 aa, Vaccinia virus; identical to SEQ ID NO: 25

SEQ ID NO: 95 - protein, 175 aa, Vaccinia virus
MTSSAMDNNEPKVLEMVYDATILPEGSSMDPNIMDCINRHINMCIQRTYSSSIIAILDRFLTMNKDELNNTQCHIIKEFMTYEQMAIDHYGEYVNAILYQIRKRPNQHHTIDLFKKIKRTRYDTFKVDPVEFVKKVIGFVSILNKYKPVYSYVLYENVLYDEFKCFIDYVETKYF

SEQ ID NO: 96 - protein, 470 aa, Vaccinia virus
MIFVIESKLLQIYRNRNINFYTTMDNIMSAEYYLSLYAKYNSKNLDVFRNMLQAIEPSGNNYHILHAYCGIKGLDERFVEELLHRGYSPNETDDDGNYPLHIASKINNNRIVAMLLTHGADPNACDKQHKTPLYYLSGTDDEVIERINLLVQYGAKINNSVDEEGCGPLLACTDPSERVFKKIMSIGFEARIVDKFGKNHIHRHLMSDNPKASTISWMMKLGISPSKPDHDGNTPLHIVCSKTVKNVDIIDLLLPSTDVNKQNKFGDSPLTLLIKTLSPAHLINKLLSTSNVITDQTVNICIFYDRDDVLEIINDKGKQYDSTDFKMAVEVGSIRCVKYLLDNDIICEDAMYYAVLSEYETMVDYLLFNHFSVDSVVNGHTCMSECVRLNNPVILSKLMLHNPTSETMYLTMKAIEKDRLDKSIIIPFIAYFVLMHPDFCKNRRYFTSYKRFVTDYVHEGVSYEVFDDYF

SEQ ID NO: 97 - protein, 220 aa, Vaccinia virus; identical to SEQ ID NO: 28

SEQ ID NO: 98 - protein, 284 aa, Vaccinia virus
MDLSRINTWKSKQLKSFLSSKDAFKADINGHSALYYAIADNNVRLVCTLLNAGALKNLLENEFPLHQAATLEDTKIVKILLFSGLDDSQFDDKGNTALYYAVDSGNMQTVKLFVKKNWRLMFYGKTGWKTSFYHAVMLNDVSIVSYFLSEIPSTFDLAILLSCIHITIKNGHVDMMILLLDYMTSTNTNNSLLFIPDIKLAIDNKDIEMLQALFKYDINIYSANLENVLLDDAEIAKMIIEKHVEYKSDSYTKDLDIVKNNKLDEIISKNKELKLMYVNCVKKN

SEQ ID NO: 99 - protein, 309 aa, Vaccinia virus
IELLKTMDLRKRDLGPAFTELISGLAKLKTSKYTYTDLTYQSFVDNTVCIKPSYYQQYHRFGLYRLNFRRDAVNKINSIVERRSGMSNVVDSNMLDNNTLWAIINTIYFKGIWQYPFDITKTRNASFTNKYGTKTVPMMNVVTKLQGNTITIDDEEYDMVRLPYKDANISMYLAIGDNMTHFTDSITAAKLDYWSSQLGNKVYNLKLPKFSIENKRDIKSIAEMMAPSMFNPDNASFKHMTRDPLYIYKMFQNAKIDVDEQGTVAEASTIMVATARSSPEKLEFNTPFVFIIRHDITGFILFMGKVESP

SEQ ID NO: 100 - protein, 88 aa, Vaccinia virus
MLAFCYSLPNAGDVIKGRVYENDYALYIYLFDYPHSEAILAESVKMHMDRYVEYRDKLVGKTVKVKVIRVDYTKGYIDVNYKRMCRHQ

SEQ ID NO: 101 - protein, 424 aa, Vaccinia virus; identical to SEQ ID NO: 85

SEQ ID NO: 102 - protein, 175 aa, Vaccinia virus
MGHSMGATISILASYDNPNLFTAMILMSPLVNADAVSRLNLLAAKLMGTITPNAPVGKLCPESVSRDMDKVYKYQYDPLINHEKIKAGFASQVLKATNKVRKIISKINTPPTLILQGTNNKISDVLGAYYFMQHANCNREIKIYEGAKHHLHKETDEVKKSVMKEIETWIFNRVK

SEQ ID NO: 103 - protein, 81 aa, Vaccinia virus; identical to SEQ ID NO: 36

SEQ ID NO: 104 - protein, 149 aa, Vaccinia virus; identical to SEQ ID NO: 37

SEQ ID NO: 105 - protein, 226 aa, Vaccinia virus; identical to SEQ ID NO: 38

SEQ ID NO: 106 - protein, 147 aa, Vaccinia virus
MFNMNINSPVRFVKETNRAKSPTRQSPGAAGYDLYSAYDYTIPPGERQLIKTDISMSMPKFCYGRIAPRSGLSLKGIDIGGGVIDEDYRGNIGVILINNGKCTFNVNTGDRIAQLIYQRIYYPELEEVQSLDSTNRGDQGFGSTGLR

SEQ ID NO: 107 - protein, 480 aa, Vaccinia virus
MPIFVNTVYCKNILALSMTKKFKTIIDAIGGNIIVNSTILKKLSPYFRTHLRQKYTKNKDPVTRVCLDLDIHSLTSIVIYSYTGKVYIDSHNVVNLLRASILTSVEFIIYTCINFILRDFRKEYCVECYMMGIEYGLSNLLCHTKNFIAKHFLELEDDIIDNFDYLSIKLILESDELNVPDEDYVVDFVIKWYIKRRNKLGNLLLLIKNVIRSNYLSPRGINNVKWILDCTKIFHCDKQPRKSYKYPFIEYPMNMDQIIDIFHMCTSTHVGEVVYLIGGWMNNEIHNNAIAVNYISNNWIPIPPMNSPRLYASGIPANNKLYVVGGLPNPTSVERWFHGDAAWVNMPSLLKPRCNPAVASINNVIYVMGGHSETDTTTEYLLPNHDQWQFGPSTYYPHYKSCALVFGRRLFLVGRNAEFYCESSNTWTLIDDPIYPRDNPELIIVDNKLLLIGGFYRESYIDTIEVYNHHTYSWNIWDGK

SEQ ID NO: 108 - protein, 222 aa, Vaccinia virus
MNHCLLAISAVYFKAKWLTPFEKEFTSDYPFYVSPTEMVDVSMMSMYGELFNHASVKESFGNFSIIELPYVGDTSMMVILPDKIDGLESIEQNLTDTNFKKWCNSLDAMFIDVHIPKFKVTGSYNLVDTLVKSGLTEVFGSTGDYSNMCNLDVSVDAMIHKTYIDVNEEYTEAAAATCALVSDCASTITNEFCVDHPFIYVIRHVDGKILFVGRYCSPTTNC

SEQ ID NO: 109 - protein, 149 aa, Vaccinia virus
MTANFSTHVFSPQHCGCDRLTSIDDVKQCLTEYIYWSSYAYRNRQCAGQLYSTLLSFRDDAELVFIDIRELVKNMPWDDVKDCTEIIRCYIPDEQKTIREISAIIGLCAYAATYWGGEDHPTSNSLNALFVMLEMLNYVDYNIIFRRMN

SEQ ID NO: 110 - protein, 91 aa, Vaccinia virus
MYNSSIHTPEYDVIIHVIEHLKHHKQCVQTVTSGMVFTSPVSSSICTKSDDGRNLSDGFLLIRYITTDDFCTIFDIIPRHIFYQLANVDEH

SEQ ID NO: 111 - protein, 326 aa, Vaccinia virus
  MOD_RES (31)..(31): Any amino acid
MSILPVIFLPIFFYSSFVQTFNASECIDKGXYFASFMELENEPVILPCPQINTLSSGYNILDILWEKRGADNDRIIPIDNGSNMLILNPTQSDSGIYICITTNETYCDMMSLNLTIVSVSESNIDFISYPQIVNERSTGEMVCPNINAFIASNVNADIIWSGHRRLRNKRLKQRTPGIITIEDVRKNDAGYYTCVLEYIYGGKTYNVTRIVKLEVRDKIIHPTMQLPEGVVTSIGSNLTIACRVSLRPPTTDADVFWISNGMYYEEDDGDGDGRISVANKIYMTDKRRVITSRLNINPVKEEDATTFTCMAFTIPSISKTVTVSIT

SEQ ID NO: 112 - protein, 75 aa, Vaccinia virus
MVIIPGVRCLSLLFLRRRCPLHIISAFTLLAINALILGHTISPVDLSFTICGYEIKSIFDSETDTIVKFNDIMSQ

SEQ ID NO: 113 - protein, 340 aa, Vaccinia virus
MSRKFMQVYEYDREQYLDEFIEDRYNDSFITSPEYYSAEKYMCRYTTLNHNCVNVRRCALDSKLLHDIITNCKIYNNIELVRATKFVYYLDLIKCNWVSKVGDSVLYPVIFITHTSTRNLDKVSVKTYKGVKVKKLNRCADHAIVINPFVKFKLTLPNKTSHAKVLVTFCKLRTDITPVEAPLPGNVLVYTFPDINKRIPGYIHVNIEGCIDGMIYINSSKFACVLKLHRSMYRIPPFPIDICSCCSQYTNDDIEIPIHDLIKDVAIFKNKETVYYLKLNNKTIARFTYFNNIDTAITQEHEYVKIALGIVCKLMINNMHSIVGVNHSNTFVNCLLEDNV

SEQ ID NO: 114 - protein, 574 aa, Vaccinia virus
MSRRLIYVLNINRKSTHKIQENEIYTYFSHCNIDHTSTELDFVVKNYDLNRRQHVTGYTALHCYLYNNYFTNDVLKILLNHDVNVTMKTSSGRMPVYILLTRCCNISHDVVIDMIDKDKNHLSHRDYSNLLLEYIKSRYMLLKEEDIDENIVSTLLDKGIDPNFKQDGYTALHYYYLCLAHVYKPGECRKPITIKKAKRIISLFIQHGANLNALDNCGNTPFHLYLSIEMCNNIHMTKMLLTFNPNFKICNNHGLTPILCYITSDYIQHDILVMLIHHYETNVGEMPIDERRMIVFEFIKTYSTRPADSITYLMNRFKNINIYTRYEGKTLLHVACEYNNTQVIDYLIRINGDINALTDNNKHATQLIIDNKENSPYTINCLLYILRYIVDKNVIRSLVDQLPSLPIFDIKSFEKFISYCILLDDTFYDRHVKNRDSKTYRYAFSKYMSFDKYDGIITKCHDETMLLKLSTVLDTTLYAVLRCHNSRKLRRYLTELKKYNNDKSFKIYSNIMNERYLNVYYKDMYVSKVYDKLFPVFTDKNCLLTLLPSEIIYEILYMLTINDLYNISYPPTKV

SEQ ID NO: 115 - protein, 353 aa, Vaccinia virus
MTMKMMVHIYFVSLSLLLLLFHSYAIDIENEITEFFNKMRDTLPAKDSKWLNPACMFGGTMNDMATLGEPFSAKCPPIEDSLLSHRYKDYVVKWERLEKNRRRQVSNKRVKHGDLWIANYTSKFSNRRYLCTVTTKNGDCVQGIVRSHIKKPPSCIPKTYELGTHDKYGIDLYCGILYAKHYNNITWYKDNKEINIDDIKYSQTGKELIIHNPELEDSGRYDCYVHYDDVRIKNDIVVSRCKILTVIPSQDHRFKLILDPKINVTIGEPANITCTAVSTSLLIDDVLIEWENPSGWLIGFDFDVYSVLTSRGGITEATLYFENVTEEYIGNTYKCRGHNYYFEKTLTTTVVLE

SEQ ID NO: 116 - protein, 127 aa, Vaccinia virus
MDEDTRLSRYLYLTDREHINVDSIKQLCKISDPNACYRCGCTALHEYFYNYRSVNGKYKYRYNGYYQYYSSSDYENYNEYYYDDYDRTGMNSESDSESDNISIKTEYENEYEFYDETQDQSTQHNDL

SEQ ID NO: 117 - protein, 91 aa, Vaccinia virus
MSLESFIITTFNNNSSTNIDNMCHLYVKVCPSSLLFRLFVECCDINKLVEGTTPLHCYLMNEGFESSVLKNLLKEYVMNTFNVHDIHYTNI

SEQ ID NO: 118 - protein, 181 aa, Vaccinia virus
MISLSFLIHNPLKKWKLKPSISINGYRSTFTMAFPCAQFRPCHCHATKDSLNTVADVRHCLTEYILWVSHRWTHRESAGSLYRLLISFRTDATELFGGELKDSLPWDNIDNCVEIIKCFIRNDSMKTAEELRAIIGLCTQSAIVSGRVFNDKYIDILLMLRKILNENDYLTLLDHIRTAKY

SEQ ID NO: 119 - protein, 386 aa, Vaccinia virus
MIAFIIFREIGIISTRIAMDYCGRECTILCRLLDEDVTYKKIKLEIETCHNLSKHIDRRGNNALHCYVSNKCDTDIKIVRLLLSRGVERLCRNNEGLTPLGAYSKHRYVKSQIVHLLISSYSNSSNELKSNINDFDLSSDNIDLRLLKYLIVDKRIRPSKNTNYAINGLGLVDIYVTTPNPRPEVLLWLLKSECYSTGYVFRTCMYNSDMCKNSLHYYISSHRESQSLSKDVIKCLINNNVSIHGRDEGGSLPIQYYWSFSTIDIEIVKLLLIKDVDTCRVYDVSPILEAYYLNKRFRVTPYNVDMEIVNLLIERRHTLVDVMRSITSYDSREYNHYIIDNILKRFRQQDESIVQAMLINYLHYGDMVVRCMLDNGQQLSSARLLC

SEQ ID NO: 120 - protein, 150 aa, Vaccinia virus
MYGLILSRFNNCGYHCYETILIDVFDILSKYMDDIDMIDNENKTLLYYAVDVNNIQFAKRLLEYGASVTTSRSIINTAIQKSSYQRENKTRIVDLLLSYHPTLETMIDAFNRDIRYLYPEPLFACIRYALILDDDFPSKVSMISPVIIRN

SEQ ID NO: 121 - protein, 91 aa, Vaccinia virus
MRRCIHIKERKIHMTNIVDRNVTFILTVVHKYVRYVPHTVANDAHNLVHLAHLIHFIIYFFIIRDVRKKKKKKKKNRTIYFFSNVYARHIK

SEQ ID NO: 122 - protein, 259 aa, Vaccinia virus
MSRINITKKIYCSVFLFLFLFLSYISNYEKVNDEMYEMGEMDEIVSIVRDSMWYIPNVFMDDGKNEGHVSVNNVCHMYFTFFDVDTSSHLFKLVIKHCDLNKRGNSPLHCYTMNTRFNPSVLKILLHHGMRNFDSKDEKGHHYLIHSLSIDNKIFDILTDTIDDFSKSSDLLLCYLRYKFNGSLNYYVLYKGSDPNCADEDELTSLHYYCKHISTFYKSNYYKLSHTKMRAEKRFIYAIIDYGANINAVTHLPSTVYQT

SEQ ID NO: 123 - protein, 103 aa, Vaccinia virus
MEQTLTRLHTYLQQYTKHSPRVVYALLSRGYVIILIVHPSWNDCATGHILIMLLNWHEQKEEGQHLLYLFIKHNQGYTLNILRYLLDRFDIQKDEYIYRLSKL

SEQ ID NO: 124 - protein, 113 aa, Vaccinia virus
MLPHTSDTTSTFRLKTVFDLVFENRNIIYKADVVNDIIHHRLKVSLPMIKSLFYKMSEFSPYDDYYVKKILAYCLLRDESFAELHSKFCLNEDYKSVFMKNISFDKIDSIIVT

SEQ ID NO: 125 - protein, 122 aa, Vaccinia virus
MKSVLYSYILFLSCIIINGRDIAPHAPSDGKCKDNEYKRHNLCPGTYASRLCDSKTNTQCTPCGSGTFTSRNNHLPACLSCNGRRDRVTLLTIESVNALPDIIVFSKDHPDARHVFPKQNVE

SEQ ID NO: 126 - protein, 244 aa, Vaccinia virus
MHVPASLQQSSSSSSSCTEEENKHHMGIDVIIKVTKQDQTPTNDKICQSVTEITESESDPDPEVESEDDSTSVEDVDPPTTYYSIIGGGLRMNFGFTKCPQIKSISESADGNTVNARLSSVSPGQGKDSPAITREEALAMIKDCEVSIDIRCSEEEKDSDIKTHPVLGSNISHKKVSYEDIIGSTIVDTKCVKNLEFSVRIGDMCKESSELEVKDGFKYVDGSASEGATDDTSLIDSTKLKACV

SEQ ID NO: 127 - protein, 345 aa, Vaccinia virus
MDIFREIASSMKGENVFISPASISSVLTILYYGANGSTAEQLSKYVEKEENMDKVSAQNISFKSINKVYGRYSAVFKDSFLRKIGDKFQTVDFTDCRTIDAINKCVDIFTEGKINPLLDEPLSPDTCLLAISAVYFKAKWLTPFEKEFTSDYPFYVSPTEMVDVSMMSMYGKAFNHASVKESFGNFSIIELPYVGDTSMMVILPDKIDGLESIEQNLTDTNFKKWCNSLEATFIDVHIPKFKVTGSYNLVDTLVKSGLTEVFGSTGDYSNMCNSDVSVDAMIHKTYIDVNEEYTEAAAATCALVSDCASTITNEFCVDHPFIYVIRHVDGKILFVGRYCSPTTNC

SEQ ID NO: 128 - protein, 149 aa, Vaccinia virus
MTANFSTHVFSPQHCGCDRLTSIDDVRQCLTEYIYWSSYAYRNRQCAGQLYSTLLSFRDDAELVFIDIRELVKNMPWDDVKDCAEIIRCYIPDEQKTIREISAIIGLCAYAATYWGGEDHPTSNSLNALFVMLEMLNYVDYNIIFRRMN

SEQ ID NO: 129 - protein, 326 aa, Vaccinia virus
MSILPVIFLSIFFYSSFVQTFNAPECIDKGQYFASFMELENEPVILPCPQINTLSSGYNILDILWEKRGADNDRIIPIDNGSNMLILNPTQSDSGIYICITTNETYCDMMSLNLTIVSVSESNIDLISYPQIVNERSTGEMVCPNINAFIASNVNADIIWSGHRRLRNKRLKQRTPGIITIEDVRKNDAGYYTCVLEYIYGGKTYNVTRIVKLEVRDKIIPSTMQLPDGIVTSIGSNLTIACRVSLRPPTTDADVFWISNGMYYEEDDGDGNGRISVANKIYMTDKRRVITSRLNINPVKEEDATTFTCMAFTIPSISKTVTVSIT

SEQ ID NO: 130 - protein, 340 aa, Vaccinia virus
MSRKFMQVYEYDREQYLDEFIEDRYNDSFITSPEYYSAEKYMCRYTTLNHNCINVRRCALDSKLLHDIITNCKIYNNIELVRATKFVYYLDLIKCNWVSKVGDSVLYPVIFITHTSTRNLDKVSVKTYKGVKVKKLNRCADHAIVINPFVKFKLTLPNKTSHAKVLVTFCKLKTDITPVEAPLPGNVLVYTFPDINKRIPGYIHLNIEGCIDGMIYINSSKFACVLKLHRSMYRIPPFPIDICSCCSQYINYDIEIPIHDLIKDVAIFKNKETVYYLKLNNKTIARFTYFNNIDTAITQEHEYVKIALGIVCKLMINNMHSIVGVNHSNTFVNCLLEDNV

SEQ ID NO: 131 - protein, 574 aa, Vaccinia virus
MSRRLIYVLNINRESTHKIQENEIYTYFSHCNIDHTSTELDFVVKNYDLNRRQPVTGYTALHCYLYNNYFTNDVLKILLNHGVDVTMKTSSGRMPVYILLTRCCNISHDVVIDMIDKDKNHLLHRDYSNLLLEYIKSRYMLLKEEDIDENIVSTLLDKGIDPNFKQDGYTALHYYYLCLAHVYKPGECRKPITIKKAKRIISLFIQHGANLNALDNCGNTPFHLYLSIEMCNNIHMTKMLLTFNPNFEICNNHGLTPILCYITSDYIQHDILVMLIHHYETNVGEMPIDERRIIVFEFIKTYSTRPADSITYLMNRFKNIDIYTRYEGKTLLHVACEYNNTHVIDYLIRINGDINALTDNNKHATQLIIDNKENSPYTINCLLYILRYIVDKNVIRSLVDQLPSLPIFDIKSFEKFISYCILLDDTFYNRHVRNRDSKTYRYAFSKYMSFDKYDGIITKCHKETILLKLSTVLDTTLYAVLRCHNSKKLRRYLTELKKYNNDKSFKIYSNIMNERYLNVYYKDMYVSKVYDKLFPVFTDKNCLLTLLPSEIIYEILYMLTINDLYNISYPPTKV

SEQ ID NO: 132 - protein, 351 aa, Vaccinia virus
MTMKMMVHIYFVSLLLLLFHSYAIDIENEITEFFNKMRDTLPAKDSKWLNPACMFGGTMNDIAALGEPFSAKCPPIEDSLLSHRYKDYVVKWERLEKNRRRQVSNKRVKHGDLWIANYTSKFSNRRYLCTVTTKNGDCVQGIVRSHIRKPPSCIPKTYELGTHDKYGIDLYCGILYAKHYNNITWYKDNKEINIDDIKYSQTGKELIIHNPELEDSGRYDCYVHYDDVRIKNDIVVSRCKILTVIPSQDHRFKLILDPKINVTIGEPANITCTAVSTSLLIDDVLIEWENPSGWLIGFDFDVYSVLTSRGGITEATLYFENVTEEYIGNTYKCRGHNYYFEKTLTTTVVLE

SEQ ID NO: 133 - protein, 56 aa, Vaccinia virus
MHVIDVDVRLYMSTFIIIDQSTENTSIDTTVTINIIYLAIMKIIMNIIMMIMIELV

SEQ ID NO: 134 - protein, 53 aa, Vaccinia virus
MNSESDNISIKTEYEFYDETQDQSTQLVGYDIKLKTNEDDFMAMIDQWVSMII

SEQ ID NO: 135 - protein, 309 aa, Vaccinia virus
MEMYPRHRYSKHSVFKGFSDKVRKNDLDMNVVKELLSNGASLTIKDSSNKDPITVYFRRTIMNLEMIDERKYIVHSYLKNYKNFDYPFFRKLVLTNKHCLNNYYNISDSKYGTPLHILASNKKLITPNYMKLLVYNGNDINARGEDTQMRTPLHKYLCKFVYHNIEYGIRYYNEKIIDAFIELGADLTIPNDDGMIPVVYCIHSNAEYGYNNITNIKIIRKLLNLSRRASHNLFRDRVMHDYISNTYIDLECLDIIRSLDGFDINGYFEGRTPLHCAIQHNFTQIAKYLLDRGADIVVPNTLIIHQYIQ

SEQ ID NO: 136 - protein, 134 aa, Vaccinia virus
MEEDTNISNKVIRYNTVNNIWETLPNFWTGTINPGVVSHKDDIYVVCDIKDEKNVKTCIFRYNTNTYNGWELVTTTESRLSALHTILYNNTIMMLHCYESYMLQDTFNVYTREWNHMCHQHSNSYIMYNILPIY

SEQ ID NO: 137 - protein, 353 aa, Vaccinia virus
MDIFKELILKHTDENVLISPVSILSTLSILNHGAAGSTAEQLSKYIENMNENTPDDNNDMDVDIPYCATLATANKIYGSDSIEFHASFLQKIKDDFQTVNFNNANQTKELINEWVKTMTNGKINSLLTSPLSINTRMTVVSAVHFKAMWKYPFSKHLTYTDKFYISKNIVTSVDMMVSTENNLQYVHINELFGGFSIIDIPYEGNSSMVIILPDDIEGIYNIEKNITDEKFKKWCGMLSTKSIDLYMPKFKVEMTEPYNLVPILENLGLTNIFGYYADFSKMCNETITVEKFLHTTFIDVNEEYTEASAVTGVFMTNFSMVYRTKVYINHPFMYMIKDNTGRILFIGKYCYPQ

SEQ ID NO: 138 - protein, 190 aa, Vaccinia virus
MMIYGLIACLIFVTSSIASPLYIPVIPPISEDKSFNSVEVLVSLFRDDQKDYTVTSQFNNYTIDTKDWTIGVLSTPDGLDIPLTNITYWSRFTIGRALFKSESEDIFQKKMSILGVSIECKKSSTLLTFLTVRKMTRVFNKFPDMAYYRGDCLKAVYVTMTYKNTKTGETDYTYLSNGGLPAYYRNGVDG

SEQ ID NO: 139 - protein, 62 aa, Vaccinia virus
MKLFTQNDRYFGLLDSCTHIFCITCINIWHKTRRETGASDNCPICRTRFRNITMSKFYKLVN

SEQ ID NO: 140 - protein, 184 aa, Vaccinia virus
MEFDPAKINTSSIDHVTILQYIDEPNDIRLTVCIIRNINNITYYINITKINTHLANQFRAWKKRIAGRDYMTNLSRDTGIQQSKLTETIRNCQKNRNIYGLYIHYNLVINVVIDWITDVIVQSILRGLVNWYIANNTYTPNTPNNTTTISELDIIKILDKYEDVYRVSKEKECGICYEVVYSKR

SEQ ID NO: 141 - protein, 331 aa, Vaccinia virus
MDIYDDKGLQTIKLFNNEFDCIRNDIRELFKHVTDSDSIQLPMEDNSDIIENIRKILYRRLKNVECVDIDSTITFMKYDPNDDNKRTCSNWVPLTNNYMEYCLVIYLETPICGGKIKLYHPTGNIKSDKDIMFAKTLDFKSKKVLTGRKTIAVLDISVSYNRSMTTIHYNDDVDIDIHTDKNGKELCYCYITIDDHYLVDVETIGVIVNRSGKCLLVNNHLGIGIVKDKRISDSFGDVCMDTIFDFSEARELFSLTNDDNRNIAWDTDKLDDDTDIWTPVTEDDYKFLSRLVLYAKSQSDTVFDYYVLTGDTEPPTVFIFKVTRFYFNMPK

SEQ ID NO: 142 - protein, 140 aa, Vaccinia virus
MSMKYLMLLFAAMIIRSFADSGNAIETTSPEITNATTDIPAIRLCGPEGDGYCLHGDCIHARDIDGMYCRCSHGYTGIRCQHVVLVDYQRSENPNTTTSYIPSPGIMLVLVGIIIITCCLLSVYRFTRRTKLPIQDMVVP

SEQ ID NO: 143 - protein, 112 aa, Vaccinia virus
MDEIVRIVRDSMWYIPNVFMDDGKNEGHVSVNNVCHMYFTFFDVDTSSHLFKLVIKHCDLNKRGNSPLHCYTMNTRFNPSVLKILLHHGMRNFDSKDEKGHHYQSITRSLIY

SEQ ID NO: 144 - protein, 109 aa, Vaccinia virus
MLFYLEEPIRGYVIILIVHPSWNDCATGHILIMLLNWHEQKEEGQHLLYLFIKHNQGYTLNILRYLLDRFDIQKDEYYNTAFQNCNNNVASYIGYDINLPTKDGIRLGV

SEQ ID NO: 145 - protein, 64 aa, Vaccinia virus
MLPHTSDTTSTFRLKTVFDLVFENRNIIYKADVVNDIIHHRLKVSLPMIKSLFYKMSLPTTITT

SEQ ID NO: 146 - protein, 48 aa, Vaccinia virus
MYDDLIEQCHLSMERKSKLVDKALNKLESTIGQSRLSYLPPEIMRNII

SEQ ID NO: 147 - protein, 122 aa, Vaccinia virus
MKSVLYSYILFLSCIIINGRDIAPHAPSDGKCKDNEYKRHNLCPGTYASRLCDSKTNTQCTPCGSGTFTSRNNHLPACLSCNGRRDRVTRLTIESVNALPDIIVFSKDHPDARHVFPKQNVE

SEQ ID NO: 148 - protein, 72 aa, Vaccinia virus
MDSLRPVVVVNWIQINFHIDIVKGITGYGFAFICGRDGVRICSETTRRTDDVSGYSVSYSTFCLGNTCLASG

SEQ ID NO: 149 - protein, 61 aa, Vaccinia virus
MWKLICIQLTTTTGLSESISTSELTITMNHKDCNPVFREEYFSVLNKVATSGFFTGERCAL

SEQ ID NO: 150 - protein, 244 aa, Vaccinia virus
MHVPASLQQSSSSSSSCTEEENKHHMGIDVIIKVTKQDQTPTNDKICQSVTEITESESDPDPEVESEDDSTSVEDVDPPTTYYSIIGGGLRMNFGFTKCPQIKSISESADGNTVNARLSSVSPGQGKDSPAITHEEALAMIKDCEVSIDIRCSEEEKDSDIKTHPVLGSNISHKKVSYEDIIGSTIVDTKCVKNLEFSVRIGDMCKESSELEVKDGFKYVDGSASEGATDDTSLIDSTKLKACV

SEQ ID NO: 151 - protein, 222 aa, Vaccinia virus
MNHCLLAISAVYFKAKWLTPFEKEFTSDYPFYVSPTEMVDVSMMSMYGKAFNHASVKESFGNFSIIELPYVGDTSMMVILPDKIDGLESIEQNLTDTNFKKWCDFMDAMFIDVHIPKFKVTGSYNLVDTLVKSGLTEVFGSTGDYSNMCNLDVSVDAMIHKTYIDVNEEYTEAAAATCALVSDCASTITNEFCVDHPFIYVIRHVDGKILFVGRYCSPTTNC

SEQ ID NO: 152 - protein, 149 aa, Vaccinia virus; identical to SEQ ID NO: 109

SEQ ID NO: 153 - protein, 91 aa, Vaccinia virus; identical to SEQ ID NO: 110

SEQ ID NO: 154 - protein, 290 aa, Vaccinia virus
MELENEPVILPCPQINTLSSGYNILDILWEKRGADNDRIIPIDNGSNMLILNPTQSDSGIYICITTNETYCDMMSLNLTIVSVLESNIDLISYPQIVNERSTGEMVCPNINAFIASNVNADIIWSGHRRLRNKRLKQRTPGIITIEDVRKNDAGYYTCVLEYIYRGKTYNVTRIVKLEVRDKIIPSTMQLPDGIVTSIGSNLTIACRVSLRPPTTDADVFWISNGMYYEEDDGDGNGRISVANKIYMTDKRRVITSRLNINPVKEEDATTFTCMAFTIPSISKTVTVSIT

SEQ ID NO: 155 - protein, 75 aa, Vaccinia virus
MVIIPGVRCLSLLFLRRRCPLHIISAFTLLAINALILGHTISPVDLSFTICGYEIRSIFDSKTDTIVKFNDIMSQ

SEQ ID NO: 156 - protein, 340 aa, Vaccinia virus
MSRKFMQVYEYDREQYLDEFIEDRYNDSFITSPEYYSAEKYMCRYTTLNHNCVNVRRCALDSKLLHDIITNCKIYNNIELVRATKFVYYLDLIKCNWVSKVGDSVLYPVIFITHTSTRNLDKVSVKTYKGVKVKKLNRCADHAIVINPFVKFKLTLPNKTSHAKVLVTFCKLRTDITQIEAPLSGNVLVYTFPNINKRIPGYIHVNIEGCIDGMIYINSSKFACVLKLHRSMYRIPPFPIDICSCCSQYTNGDIEIPIHDLIKDVAIFKNKETVYYLKLNNKTIARFTYFNNIDTAITQEHEYVKIALGIVCKLMINNMHSIVGVNHSNTFVNCLLEDNV

SEQ ID NO: 157 - protein, 574 aa, Vaccinia virus
MSRRLIYVLNINRESTHKIQENEIYTYFSHCNIDHTSTELDFVVKNYDLNRRHPVTGYTALHCYLYNNYFTNDVLKILLNHGVDVTMKTSSGRMPVYILLTRCCNISHDVVIDMIDKDKNHLLHRDYSNLLLEYIKSRYMLLKEEDIDENIVSTLLDKGIDPNFKQDGYTALHYYYLCLAHVYKPGECRKPITIKKAKRIISLFIQHGANLNALDNCGNTPFHLYLSIEMCNNIHMTKMLLTFNPNFKICNNHGLTPILCYITSDYIQHDILVMLIHHYETNVGEMPIDERRIIVFEFIKTYSTRPADSITYLMNRFKNINIYTRYEGKTLLHVACEYNNTQVIDYLIRINGDINALTDNNKHATQLIIDNKENSPYTINCLLYILRYIVDKNVIRSLVDQLPSLPIFDIKSFEKFISYCILLDDTFYDRHVKNRNSKTYRYAFSKYMSFDKYDGIITKCHDETMLLKLSTVLDTTLYAVLRCHNSRKLRRYLTELKKYNNDKSFKIYSNIMNERYLNVYYKDMYVSKVYDKLFPVFTDKNCLLTLLPSEIIYEILYMLTINDLYNISYPPTKV

SEQ ID NO: 158 - protein, 353 aa, Vaccinia virus
MTMKMMVHIYFVSLSLLLLLFHSYAIDIENEITEFFNKMRDTLPAKDSKWLNPACMFGGTMNDIAALGEPFSAKCPPIEDSLLSHRYKDYVVKWERLEKNRRRQVSNKRVKHGDLWIANYTSKFSNRRYLCTVTTKNGDCVQGIVRSHIKKPPSCIPKTYELGTHDKYGIDLYCGILYAKHYNNITWYKDNKEINIDDIKYSQTGKELIIHNPELEDSGRYDCYVHYDDVRIKNDIVVSRCKILTVIPSQDHRFKLILDPKINVTIGEPANITCTAVSTSLLIDDVLIEWENPSGWLIGFDFDVYSVLTSRGGITEATLYFENVTEEYIGNTYKCRGHNYYFEKTLTTTVVLE

SEQ ID NO: 159 - protein, 56 aa, Vaccinia virus; identical to SEQ ID NO: 133

SEQ ID NO: 160 - protein, 271 aa, Vaccinia virus
LKNVECVDIDSTITFMKYDPNDDNKRTCSNWVPLTNNYMEYCLVIYLETPICGGKIKLYHPTGNIKSDKDIMFAKTLDFKSTKVLTGRKTIAVLDISVSYNRSMTTIHYNDDVDIDIHTDKNGKELCYCYITIDDHYLVDVETIGVIVNRSGKCLLVNNHLGIGIVKDKRISDSFGDVCMDTIFDFSEARELFSLTNDDNRNIAWDTDKLDDDTDIWTPVTENDYKFLSRLVLYAKSQSDTVFDYYVLTGDTEPPTVFIFKVTRFYFNMPK

SEQ ID NO: 161 - protein, 74 aa, Vaccinia virus
MYCRCSHGYTGIRCQHVVLVDYQRSEKPNTTTSYIPSPGIMLVLVGIIIITCCLLSVYRFTRRTKLPLQDMVVP

SEQ ID NO: 162 - protein, 244 aa, Vaccinia virus; identical to SEQ ID NO: 150

SEQ ID NO: 163 - protein, 222 aa, Vaccinia virus
MNHCLLAISAVYFKAKWLTPFEKEFTSDYPFYVSPTEMVDVSMMSMYGKAFNHASVKESFGNFSIIELPYVGDTSMMVILPDKIDGLESIEQNLTDTNFKKWCDFMDAMFIDVHIPKFKVTGSYNLVDTLVKSGLTEVFGSTGDYSNMCNLDVSVDAMIHKTYIDVNEEYTEAAAATCALVSDCASTVTNEFCADHPFIYVIRHVDGKILFVGRYCSPTTNC

SEQ ID NO: 164 - protein, 149 aa, Vaccinia virus
MTANFSTHVFSPQHCGCDRLTSIDDVKQCLTEYIYWSSYAYRNRQCAGQLYSTLLSFRDDAELVFIDIRELVKHMPWDDVKDCAEIIRCYIPDEQKTIREISAIIGLCAYAATYWGGEDHPTSNSLNALFVMLEMLNYVDYNIIFRRMN

SEQ ID NO: 165 - protein, 326 aa, Vaccinia virus
MSILPVIFLSIFFYSSFVQTFNASECIDKGQYFASFMELENEPVILPCPQINTLSSGYNILDILWEKRGADNDRIIPIDNGSNMLILNPTQSDSGIYICITTNETYCDMMSLNLTIVSVSESNIDLISYPQIVNERSTGEMVCPNINAFIASNVNADIIWSGHRRLRNKRLKQRTPGIITIEDVRKNDAGYYTCVLEYIYGGKTYNVTRIVKLEVRDKIIPSTMQLPDGIVTSIGSNLTIACRVSLRPPTTDTDVFWISNGMYYEEDDGDGDGRISVANKIYMTDKRRVITSRLNINPVKEEDATTFTCMAFTIPSISKTVTVSIT

SEQ ID NO: 166 - protein, 340 aa, Vaccinia virus
MSRKFMQVYEYDREQYLDEFIEDRYNDSFITSPEYYSAEKYMCRYTTLNHNCVNVRRCALDSKLLHDIITNCKIYNNIELVRATKFVYYLDLIKCNWVSKVGDSVLYPVIFITHTSTRNLDKVSVKTYKGVKVKKLNRCADHAIVINPFVKFKLTLPNKTSHAKVLVTFCKLRTDITQIEAPLSGNVLVYTFPDINKRIPGYIHVNIEGCIDGMIYINSSKFACVLKLHRSMYRIPPFPIDICSCCSQYTNDDIEIPIHDLIKDVAIFKNKETVYYLKLNNKTIARFTYFNNIDTAITQEHEYVKIALGIVCKLMINNMHSIVGVNHSNTFVNCLLEDNV

SEQ ID NO: 167 - protein, 574 aa, Vaccinia virus
MSRRLIYVLNINRESTHKIQENEIYTYFSHCNIDHTSTELDFVVKNYDLNRRQPVTGYTALHCYLYNNYFTNDVLKILLNHGVDVTMKTSSGRMPVYILLTRCCNISHDVVIDMIDKDKNHLSHRDYSNLLLEYIKSRYMLLKEEDIDENIVSTLLDKGIDPNFKQDGYTALHYYYLCLAHVYKPGECRKPITIKKAKRIISLFIQHGANLNALDNCGNTPFHLYLSIEMCNNIHMTKMLLTFNPNFKICNNHGLTPILCYITSDYIQHDILVMLIHHYETNVGEMPIDERRIIVFEFIKTYSTRPADSITYLMNRFKNINIYTRYEGKTLLHVACEYNNTHVIDYLIRINGDINALTDNNKHAIQLIIDNKENSPYTIDCLLYILRYIVDKNVIRSLVDQLPSLPIFDIKSFEKFISYCILLDDTFYNRHVRNRNSKTYRYAFSKYMSFDKYDGIITKCHDETMLLKLSTVLDTTLYAVLRCHNSKKLRRYLNELKKYNNDKSFKIYSNIMNERYLNVYYKDMYVSKVYDKLFPVFTDKNCLLTLLPSEIIYEILYMLTINDLYNISYPPTKV

SEQ ID NO: 168 - protein, 265 aa, Vaccinia virus
MTMKMMVHIYFVSLSLLLLLFHSYAIDIENEITEFFNKMRDTLPAKDSKWLNPACMFGGTMNDIATLGEPFSAKCPPIEDSLLSHRYKDYVVKWERLEKNRRRQVSNKRVKHGDLWIANYTSKFSNRRYLCTVTTKNGDCVQGIVRSHIRKPPSCIPKTYELGTHDKYGIDLYCGILYAKHYNNITWYKDNKEINIDDIKYSQTGKKLIIHNPELEDSGRYDCYVHYDDVRIKNDIVVSRCKILTVIPSQDHRFKLKRNCGYASN

SEQ ID NO: 169 - protein, 91 aa, Vaccinia virus
MRQIKINGTDMLTVMYMLNKPTKKRYVNNPIFTDWANKQYKFYNQIIYNANKLIEQSKKIDDMIEEVSIDDNRLSTLPLEIRHLIFSYAFL

SEQ ID NO: 170 - protein, 55 aa, Vaccinia virus
MSSKGGSGGMWSVFIHGHDGSNKGSKTYTSGGGGMWGGGSSSGVNGGVKSGTGKI

SEQ ID NO: 171 - protein, 71 aa, Vaccinia virus
MFDYLENEEVALDELKQMLRDRDPNDTRNQFKNNALHAYLFNEHCNNVEVVKLLLDSGTNPLRKNWRQLPH

SEQ ID NO: 172 - protein, 83 aa, Vaccinia virus
MLKLKDIAMALLEATGFSNINDFNIFSYMKSKNVDVDLIKVLVEHGFDLSVKCENHRSVIENYVMTMILFIENGCSVLYEDEY

SEQ ID NO: 173 - protein, 170 aa, Vaccinia virus
MKGIDNTAYSYIDDLTCCTRGIMADYLNSDYRYNKDVDLVKLFLENGKPHGIMCSIVPLWRNDKETIFLILKTMNSDVLQHILIEYMTFGDIPLVEYGTVVNKEAIHGYFRNINIDSYTMKYLLKKEGRCHQLSRLDTYVNPTMDVIISTLIHTKRVFVTCLMLAQFLVL

SEQ ID NO: 174 - protein, 173 aa, Vaccinia virus
MPSIISIGHLCKSNYGCYNFYTYTYKKGLCDMSYACPILSTINICLPYLKDINMIDKRGETLLHKAVRYNKQSLVSLLLESGSDVNIRSNNGYTCIAIAINESKNIELLKMLLCHKPTLDYVIDSLREISNIVDNDYAIKQCIKYAMIIDDCTSSKIPEFISQRYNDYIDLCN

SEQ ID NO: 175 - protein, 90 aa, Vaccinia virus
MKKIMVGGNTMFSLIFTDHGAKIIHRYANNPELREYYELKQNKIYVEAYDIISNAIVKHDRIHKTIESVDDNTYISNLPYTIKYKIFEQQ

SEQ ID NO: 176 - protein, 126 aa, Vaccinia virus
MRILFLIAFMYGCVHSYVNAVETKCSNLDIVTSSGEFHCSGCVEHMPNFSYMYWLAKDMRSDEDAKFIEHLGEGIKEDETVRTIDGRIVTLQKVLHVTDTNKFAHYRFTCVLTTIDGVSKKNIWLK

SEQ ID NO: 177 - protein, 62 aa, Vaccinia virus
MKLFTQNDRYFGLLDSCNHIFCITCINIWHKTRRETGASDNCPICRTRFRNITMSKFYKLVN

SEQ ID NO: 178 - protein, 66 aa, Vaccinia virus
MHYPKYYINITKINPHLANQFRAWKKRIAGRDYMTNLSKDTGIQQSKLYVTVKKIETYMVYIYTTI

SEQ ID NO: 179 - protein, 331 aa, Vaccinia virus
MDIYDDKGLQTIKLFNNEFDCIRNDIRELFKHVTDSDSIQLPMEDNSDIIENIRKILYRRLKNVECVDIDNTITFMKYDPNDDNKRTCSNWVPLTNNYMEYCLVIYLETPICGGKIKLYHPTGNIKSDKDIMFAKTLDFKSKKVLTGRKTIAVLDISVSYNRSITTIHYNDDVDIDIHTDKNGKELCYCYITIDDHYLVDVETIGVIVNRSGKCLLVNNHLGIGIVKDKRISDSFGDVCMDTIFDFSEARELFSLTNDDNRNIAWDTDKLDDDTDIWTPVTENDYKFLSRLVLYAKSQSDTVFDYYVLTGDTEPPTVFIFKVTRFYFNMPK

SEQ ID NO: 180 - protein, 141 aa, Vaccinia virus
MLINYLMLLFAAMIIRSFADSGNAIETTLPEITNATTDIPAIRLCGPEGDGYCLHGDCIHARDIDGMYCRCSHGYTGIRCQHVVLVDYQRSEKPNTTTSYIPSPGIMLVLVGIIIITCCLLSVYRFTRRTNKLPLQDMVVP

SEQ ID NO: 181 - protein, 357 aa, Vaccinia virus
MDIFKELIVKHPDENVLISPVSILSTLSILNHGAAGSTAEQLSKYIENMNENTPDDKKDDNNDMDVDIPYCATLATANKIYGSDSIEFHASFLQKIKDDFQTVNFNNANQTKELINEWVKTMTNGKINSLLTSPLSINTRMTVVSAVHFKAMWKYPFSKHLTYTDKFYISKNIVTSVDMMVGTENNLQYVHINELFGGFSIIDIPYEGNSSMVIILPDDIEGIYNIEKNITDEKFKKWCGMLSTKSIDLYMPKFKVEMTEPYNLVPILENLGLTNIFGYYADFSKMCNETITVEKFLHTTFIDVNEEYTEASAVTGVFMTNFAMVYRTKVYINHPFMYMIKDTTGRILFIGKYCYPQ

SEQ ID NO: 182 - protein, 190 aa, Vaccinia virus
MMIYGLIACLIFVTSSIASPLYIPVIPPITEDKSFNSVEVLVSLFRDDQKDYTVTSQFNNYTIDTKDWTIGVLSTPDGLDIPLTNITYWSRFTIGRALFKSESEDIFQKKMSILGVSIECKKSSTLLTFLTVRKMTRVFNKFPDMAYYRGDCLKAVYVTMTYKNTKTGETDYTYLSNGGLPAYYRNGVDG

SEQ ID NO: 183 - protein, 51 aa, Vaccinia virus
MNLQKLSLAIYLTATCSWCYETCIRKTALYHDIQLEHVEDNKDSVASLPYK

SEQ ID NO: 184 - protein, 87 aa, Vaccinia virus
MSLESFIITTFNNNSSTNIDNMCHLYVKVCPSSLLFRLFVECCDINKLVEGTTPLHCYLMNEGFESSVLKNLLKEYVMTSITQIFNS

SEQ ID NO: 185 - protein, 181 aa, Vaccinia virus
MISLSFLIHNPLKKWKLKPSISINGYRSTFTMAFPCAQFRPCHCHATKDSLNTVADVRHCLTEYILWVSHRWTHRETAGPLYRLLISFRTDATELFGGELKDSLPWDNIDNCVEIIKCFIRNDSMKTAEELRAIIGLCTQSAIVSGRVFNDKYIDILLMLRKILNENDYLTLLDHIRTAKY

SEQ ID NO: 186 - protein, 382 aa, Vaccinia virus
MIAFIIFREIGIISTRIAMDCTCILCRLLDEDVTYKKIKLEIETCHNLSKHIDRRGNNALHCYVFNKCDTDIKIVRLLLSRGVERLCRNNEGLTPLGVYSKHRYVKSQIVHLLISSYSNSSNELKSNINDFDLSSDNIDLRLLKYLIVDKRIRPSKNTNYAINSLGLVDIYVTTPNPRPEVLLWLLKSECYSTGYVFRTCMYNSDMCKNSLHYYISSHRESQSLSKDVIKCLINNNVSIHGRDEGGSLPIQYYWSFSTIDIEIVKLLLIKDVDTCRVYDVSPILEAYYLNKRFRVTPYNVDMEIVNLLIERRHTLVDVMRSITSYDSREYNHYIIDNILKRFRQQDESIVQAMLINYLHYGDMVVRCMLDNGQQLSSARLLC

SEQ ID NO: 187 - protein, 198 aa, Vaccinia virus
MYGLILSRFNNCGYHCYETILIDVFDILSKYMDNIDMIDNENKTLLYYAVDVNNIQFAKRLLEYGASVTTSRSIINTAIQKSSYRRENKTKLVDLLLSYHPTLETMIDAFNRDIRYLYPEPLFACIRYALILDDDFPSKVKYDISGRHKELKRYRVDINRMKNAYISGVSMFDILFKRSKRHRLRYAKNPTSNGTKKN

SEQ ID NO: 188 - protein, 147 aa, Vaccinia virus
MSRINITKKIYCSVFLFLFLSYISNYEKVNDEMYEMGEMDEIVSIVRDSMWYIPNVFMDDGKNEGHVSVNNVCHMYFTFFDVDTSSHLFKLVIKHCDLNKRGNSPLHCYTMNTRFNPSVLKILLHHGMRNFDSKDDHYQSITRSLIY

SEQ ID NO: 189 - protein, 128 aa, Vaccinia virus
MEQTLTRLHTYLQQYTKHSPRVVYALLSRGYVIILIVHPSWNDCATGHILIMLLNWHEQKEEGQHLLYLFIKHNQGYTLNILRYLLDRFDIQKDEYYNTAFQNCNNNVASYIGYDINLPTKDGIRLGV

SEQ ID NO: 190 - protein, 111 aa, Vaccinia virus
MLPHTSDTTSTFRLKTVFDLVFENRNIIYKADVVNDIIHHRLKVPMIKSLFYKMSEFSPYDDYYVKKILAYCLLRDESFAELHSKFCLNEDYKSVFMKNISFDKIDSIIVT

SEQ ID NO: 191 - protein, 94 aa, Vaccinia virus
MHHPMESVKTTNTNAIICVREHTLPDYANTQCTPCGSGTFTSRNNHLPACLSCNGRRDRVTLLTIESVNALPDIIVFSKDHPDARHVFPKQNVE

SEQ ID NO: 192 - protein, 241 aa, Vaccinia virus
MHVPASLQQSSSSCTEEENKHHMGIDVIIKVTKQDQTPTNDKICQSVTEITESESDPDPEVESEDDSTSVEDVDLPTTYYSIIGGGLRMNFGFTKCPQIKSISESADGNTVNARLSSVSPGQGKDSPAITHEEALAMIKDCEVSIDIRCSEEEKDSDIKTHPVLGSNISHKKVSYEDIIGSTIVDTKCVKNLEFSVRIGDMCKESSELEVKDGFKYVDGSASEGATDDTSLIDSTKLKACV

SEQ ID NO: 193 - protein, 62 aa, Vaccinia virus; identical to SEQ ID NO: 177

SEQ ID NO: 194 - protein, 66 aa, Vaccinia virus; identical to SEQ ID NO: 178

SEQ ID NO: 195 - protein, 331 aa, Vaccinia virus; identical to SEQ ID NO: 179

SEQ ID NO: 196 - protein, 141 aa, Vaccinia virus; identical to SEQ ID NO: 180

SEQ ID NO: 197 - protein, 94 aa, Vaccinia virus; identical to SEQ ID NO: 191

SEQ ID NO: 198 - protein, 241 aa, Vaccinia virus; identical to SEQ ID NO: 192

SEQ ID NO: 199 - skipped

SEQ ID NO: 200 - protein, 149 aa, Vaccinia virus; identical to SEQ ID NO: 109

SEQ ID NO: 201 - protein, 326 aa, Vaccinia virus
MSILPVIFLPIFFYSSFVQTFNAPECIDKGQYFASFMELENEPVILPCPQINTLSSGYNILDILWEKRGADNDRIIPIDNGSNMLILNPTQSDSGIYICITTNETYCDMMSLNLTIVSVSESNIDLISYPQIVNERSTGEMVCPNINAFIASNVNADIIWSGHRRLRNKRLKQRTPGIITIEDVRKNDAGYYTCVLEYIYRGKTYNVTRIVKLEVRDKIIPSTMQLPDGIVTSIGSNLTIACRVSLRPPTTDADVFWISNGMYYEEDDGDGNGRISVANKIYMTDKRRVITSRLNINPVKEEDATTFTCMAFTIPSISKTVTVSIT

SEQ ID NO: 202 - protein, 340 aa, Vaccinia virus
MSRKFMQVYEYDREQYLDEFIEDRYNDSFITSPEYYSAEKYMCRYTTLNHNCINVRRCALDSKLLHDIITNCKIYNNIELVRATKFVYYLDLIKCNWVSKVGDSVLYPVIFITHTSTRNLDKVSVKTYKGVKVKKLNRCADHAIVINPFVKFKLTLPNKTSHAKVLVTFCKLRTDITQIEAPLSGNVLVYTFPDINKRIPGYIHVNIEGCIDGMIYINSSKFACVLKLHRSMYRIPPFPIDICSCCSQYTNDDIEIPIHDLIKDVAIFKNKETVYYLKLNNKTIARFTYFNNIDTAITQEHEYVKIALGIVCKLMINNMHSIVGVNHSNTFVNCLLEDNV

SEQ ID NO: 203 - protein, 167 aa, Vaccinia virus
MTKVIIILGFLIINTNSLSMKCEQGVSYYNSQELKCCKLCKPGTYSDHRCDKYSDTICGHCPSDTFTSIYNRSPWCHSCRGPCGTNRVEVTPCTPTTNRICHCDSNSYCLLKASDGNCVTCAPKTKCGRGYGKKGEDEMGNTICKKCRKGTYSDIVSDSDQCKPMTR

SEQ ID NO: 204 - protein, 237 aa, Vaccinia virus
MAMPSLSACSSIEDDFNYGSSVASASVHIRMAFLRKVYGILCLQFLLTTATTAVFLYFDCMRTFIQGSPVLILASMFGSIGLIFALTLHRHKHPLNLYLLCGFTLSESLTLASVVTFYDVHVVMQAFMLTTAAFLALTTYTLQSKRDFSKLGAGLFAALWILILSGLLGIFVQNETVKLVLSAFGALVFCGFIIYDTHSLIHKLSPEEYVLASINLYLDIINLFLHLLQLLEVSNKK

SEQ ID NO: 205 - protein, 147 aa, Vaccinia virus
MASPCAKFRPCHCHATKDSLNTVADVRHCLTEYILWVSHRWTHRESAGSLYRLLISFRTDATELFGGELKDSLPWDNCVEIIKCFIRNDSMKTAEELRAIIGLCTQSAIVSGRVFNDKYIDILLMLRKILNENDYLTLLDHIRTAKY

SEQ ID NO: 206 - protein, 128 aa, Vaccinia virus; identical to SEQ ID NO: 189

SEQ ID NO: 207 - protein, 64 aa, Vaccinia virus; identical to SEQ ID NO: 145

SEQ ID NO: 208 - protein, 258 aa, Vaccinia virus
MKQYIVLACMCLAAAAMPASLQQSSSSSSSCTEEENKHHMGIDVIIKVTKQDQTPTNDKICQSVTEITESESDPDPEVESEDDSTSVEDVDPPTTYYSIIGGGLRMNFGFTKCPQIKSISESADGNTVNARLSSVSPGQGKDSPAITHEEALAMIKDCEVSIDIRCSEEEKDSDIKTHPVLGSNISHKKVSYEDIIGSTIVDTKCVKNLEFSVRIGDMCKESSELEVKDGFKYVDGSASEGATDDTSLIDSTKLKACV

SEQ ID NO: 209 - protein, 271 aa, Vaccinia virus
MRYIIILAVLFINSIHAKITSYKFESVNFDSKIEWTGDGLYNISLKNYGIKTWQTMYTNVPEGTYDISAFPKNDFVSFWVKFEQGDYKVEEYCTGLCVEVKIGPPTVTLTEYDDHINLYIEHPYATRGSKKIPIYKRGDMCDIYLLYTANFTFGDSEEPVTYDIDDYDCTSTGCSIDFATTEKVCVTAQGATEGFLEKITPWSSEVCLTPKKNVYTCAIRKEDVPNFKDKMARVIKRKFNKQSQSYLTKFLGSTSNDVTTFLSMLNLTKYS

SEQ ID NO: 210 - protein, 9 aa, Unknown
  Description of Unknown: immunogenic epitope
FLGYLILGV

SEQ ID NO: 211 - protein, 15 aa, Unknown
  Description of Unknown: immunogenic epitope
SVSESDTIRSISIAS

SEQ ID NO: 212 - protein, 15 aa, Unknown
  Description of Unknown: immunogenic epitope
LLANGRMPTVLQCVN

SEQ ID NO: 213 - protein, 15 aa, Unknown
  Description of Unknown: immunogenic epitope
RMPTVLQCVNVSVVS

SEQ ID NO: 214 - protein, 12 aa, Unknown
  Description of Unknown: immunogenic epitope
CTACRWKKACQR

SEQ ID NO: 215 - protein, 9 aa, Unknown
  Description of Unknown: immunogenic epitope
VLDGLDVLL

SEQ ID NO: 216 - protein, 10 aa, Unknown
  Description of Unknown: immunogenic epitope
SLYSFPEPEA

SEQ ID NO: 217 - protein, 10 aa, Unknown
  Description of Unknown: immunogenic epitope
ALYVDSLFFL

SEQ ID NO: 218 - protein, 9 aa, Unknown
  Description of Unknown: immunogenic epitope
SLLQHLIGL

SEQ ID NO: 219 - protein, 9 aa, Unknown
  Description of Unknown: immunogenic epitope
LYVDSLFFL

SEQ ID NO: 220 - protein, 11 aa, Unknown
  Description of Unknown: immunogenic epitope
TSEKRPFMCAY

SEQ ID NO: 221 - protein, 9 aa, Unknown
  Description of Unknown: immunogenic epitope
CMTWNQMNL

SEQ ID NO: 222 - protein, 11 aa, Unknown
  Description of Unknown: immunogenic epitope
LSHLQMHSRKH

SEQ ID NO: 223 - protein, 16 aa, Unknown
  Description of Unknown: immunogenic epitope
KRYFKLSHLQMHSRKH

SEQ ID NO: 224 - protein, 8 aa, Unknown
  Description of Unknown: immunogenic epitope
CYMEAVAL

SEQ ID NO: 225 - protein, 9 aa, Unknown
  Description of Unknown: immunogenic epitope
SLLFLLFSL

SEQ ID NO: 226 - protein, 9 aa, Unknown
  Description of Unknown: immunogenic epitope
VLPLTVAEV

SEQ ID NO: 227 - protein, 9 aa, Unknown
  Description of Unknown: immunogenic epitope
ALQGGGPPY

SEQ ID NO: 228 - protein, 9 aa, Unknown
  Description of Unknown: immunogenic epitope
LYPKARLAF

SEQ ID NO: 229 - protein, 9 aa, Unknown
  Description of Unknown: immunogenic epitope
AFLPWHRLF

SEQ ID NO: 230 - protein, 9 aa, Unknown
  Description of Unknown: immunogenic epitope
SLLMWITQC

SEQ ID NO: 231 - protein, 9 aa, Unknown
  Description of Unknown: immunogenic epitope
LAMPFATPM

SEQ ID NO: 232 - protein, 9 aa, Unknown
  Description of Unknown: immunogenic epitope
ARGPESRLL

SEQ ID NO: 233 - protein, 11 aa, Unknown
  Description of Unknown: immunogenic epitope
MLMAQEALAFL

SEQ ID NO: 234 - protein, 11 aa, Unknown
  Description of Unknown: immunogenic epitope
YLAMPFATPME

SEQ ID NO: 235 - protein, 10 aa, Unknown
  Description of Unknown: immunogenic epitope
ASGPGGGAPR

SEQ ID NO: 236 - protein, 10 aa, Unknown
  Description of Unknown: immunogenic epitope
LAAQERRVPR

SEQ ID NO: 237 - protein, 10 aa, Unknown
  Description of Unknown: immunogenic epitope
TVSGNILTIR

SEQ ID NO: 238 - protein, 13 aa, Unknown
  Description of Unknown: immunogenic epitope
APRGPHGGAASGL

SEQ ID NO: 239 - protein, 11 aa, Unknown
  Description of Unknown: immunogenic epitope
MPFATPMEAEL

SEQ ID NO: 240 - protein, 12 aa, Unknown
  Description of Unknown: immunogenic epitope
KEFTVSGNILTI

SEQ ID NO: 241 - protein, 9 aa, Unknown
  Description of Unknown: immunogenic epitope
MPFATPMEA

SEQ ID NO: 242 - protein, 9 aa, Unknown
  Description of Unknown: immunogenic epitope
FATPMEAEL

SEQ ID NO: 243 - protein, 11 aa, Unknown
  Description of Unknown: immunogenic epitope
FATPMEAELAR

SEQ ID NO: 244 - protein, 14 aa, Unknown
  Description of Unknown: immunogenic epitope
SLLMWITQCFLPVF

SEQ ID NO: 245 - protein, 25 aa, Unknown
  Description of Unknown: immunogenic epitope
LLEFYLAMPFATPMEAELARRSLAQ

SEQ ID NO: 246 - protein, 12 aa, Unknown
  Description of Unknown: immunogenic epitope
EFYLAMPFATPM

SEQ ID NO: 247 - protein, 25 aa, Unknown
  Description of Unknown: immunogenic epitope
PGVLLKEFTVSGNILTIRLTAADHR

SEQ ID NO: 248 - protein, 12 aa, Unknown
  Description of Unknown: immunogenic epitope
RLLEFYLAMPFA

SEQ ID NO: 249 - protein, 20 aa, Unknown
  Description of Unknown: immunogenic epitope
QGAMLAAQERRVPRAAEVPR

SEQ ID NO: 250 - protein, 13 aa, Unknown
  Description of Unknown: immunogenic epitope
PFATPMEAELARR

SEQ ID NO: 251 - protein, 20 aa, Unknown
  Description of Unknown: immunogenic epitope
PGVLLKEFTVSGNILTIRLT

SEQ ID NO: 252 - protein, 10 aa, Unknown
  Description of Unknown: immunogenic epitope
VLLKEFTVSG

SEQ ID NO: 253 - protein, 18 aa, Unknown
  Description of Unknown: immunogenic epitope
AADHRQLQLSISSCLQQL

SEQ ID NO: 254 - protein, 15 aa, Unknown
  Description of Unknown: immunogenic epitope
LKEFTVSGNILTIRL

SEQ ID NO: 255 - protein, 11 aa, Unknown
  Description of Unknown: immunogenic epitope
KEFTVSGNILT

SEQ ID NO: 256 - protein, 14 aa, Unknown
  Description of Unknown: immunogenic epitope
LLEFYLAMPFATPM

SEQ ID NO: 257 - protein, 14 aa, Unknown
  Description of Unknown: immunogenic epitope
AGATGGRGPRGAGA

SEQ ID NO: 258 - protein, 13 aa, Unknown
  Description of Unknown: immunogenic epitope
TYYRPGVNLSLSC

SEQ ID NO: 259 - protein, 13 aa, Unknown
  Description of Unknown: immunogenic epitope
EIIYPNASLLIQN

SEQ ID NO: 260 - protein, 15 aa, Unknown
  Description of Unknown: immunogenic epitope
YACFVSNLATGRNNS

SEQ ID NO: 261 - protein, 13 aa, Unknown
  Description of Unknown: immunogenic epitope
LWWVNNQSLPVSP

SEQ ID NO: 262 - protein, 13 aa, Unknown
  Description of Unknown: immunogenic epitope
NSIVKSITVSASG

SEQ ID NO: 263 - protein, 9 aa, Unknown
  Description of Unknown: immunogenic epitope
KTWGQYWQV

SEQ ID NO: 264 - protein, 10 aa, Unknown
  Description of Unknown: immunogenic epitope
AMLGTHTMEV

SEQ ID NO: 265 - protein, 9 aa, Unknown
  Description of Unknown: immunogenic epitope
ITDQVPFSV

SEQ ID NO: 266 - protein, 9 aa, Unknown
  Description of Unknown: immunogenic epitope
YLEPGPVTA

SEQ ID NO: 267 - protein, 10 aa, Unknown
  Description of Unknown: immunogenic epitope
LLDGTATLRL

SEQ ID NO: 268 - protein, 10 aa, Unknown
  Description of Unknown: immunogenic epitope
VLYRYGSFSV

SEQ ID NO: 269 - protein, 10 aa, Unknown
  Description of Unknown: immunogenic epitope
SLADTNSLAV

SEQ ID NO: 270 - protein, 9 aa, Unknown
  Description of Unknown: immunogenic epitope
RLMKQDFSV

SEQ ID NO: 271 - protein, 9 aa, Unknown
  Description of Unknown: immunogenic epitope
RLPRIFCSC

SEQ ID NO: 272 - protein, 9 aa, Unknown
  Description of Unknown: immunogenic epitope
LIYRRRLMK

SEQ ID NO: 273 - protein, 9 aa, Unknown
  Description of Unknown: immunogenic epitope
ALLAVGATK

SEQ ID NO: 274 - protein, 10 aa, Unknown
  Description of Unknown: immunogenic epitope
IALNFPGSQK

SEQ ID NO: 275 - protein, 9 aa, Unknown
  Description of Unknown: immunogenic epitope
RSYVPLAHR

SEQ ID NO: 276 - protein, 9 aa, Unknown
  Description of Unknown: immunogenic epitope
VVPCEPPEV

SEQ ID NO: 277 - protein, 9 aa, Unknown
  Description of Unknown: immunogenic epitope
HLYQGCQVV

SEQ ID NO: 278 - protein, 10 aa, Unknown
  Description of Unknown: immunogenic epitope
YLVPQQGFFC

SEQ ID NO: 279 - protein, 9 aa, Unknown
  Description of Unknown: immunogenic epitope
PLQPEQLQV

SEQ ID NO: 280 - protein, 9 aa, Unknown
  Description of Unknown: immunogenic epitope
TLEEITGYL

SEQ ID NO: 281 - protein, 9 aa, Unknown
  Description of Unknown: immunogenic epitope
ALIHHNTHL

SEQ ID NO: 282 - protein, 9 aa, Unknown
  Description of Unknown: immunogenic epitope
PLTSIISAV

SEQ ID NO: 283 - protein, 9 aa, Unknown
  Description of Unknown: immunogenic epitope
VLRENTSPK

SEQ ID NO: 284 - protein, 9 aa, Unknown
  Description of Unknown: immunogenic epitope
TYLPTNASL

SEQ ID NO: 285 - protein, 9 aa, Unknown
  Description of Unknown: immunogenic epitope
RYQLDPKFI

SEQ ID NO: 286 - protein, 9 aa, Unknown
  Description of Unknown: immunogenic epitope
ILFTINFTI

SEQ ID NO: 287 - protein, 9 aa, Unknown
  Description of Unknown: immunogenic epitope
VLFTINFTI

SEQ ID NO: 288 - protein, 9 aa, Unknown
  Description of Unknown: immunogenic epitope
TLNFTITNL

SEQ ID NO: 289 - protein, 9 aa, Unknown
  Description of Unknown: immunogenic epitope
VLQGLLKPL

SEQ ID NO: 290 - protein, 9 aa, Unknown
  Description of Unknown: immunogenic epitope
VLQGLLRPV

SEQ ID NO: 291 - protein, 9 aa, Unknown
  Description of Unknown: immunogenic epitope
RLDPKSPGV

SEQ ID NO: 292 - protein, 9 aa, Unknown
  Description of Unknown: immunogenic epitope
QLYWELSKL

SEQ ID NO: 293 - protein, 9 aa, Unknown
  Description of Unknown: immunogenic epitope
KLTRGIVEL

SEQ ID NO: 294 - protein, 9 aa, Unknown
  Description of Unknown: immunogenic epitope
QLTNGITEL

SEQ ID NO: 295 - protein, 9 aa, Unknown
  Description of Unknown: immunogenic epitope
QLTHNITEL

SEQ ID NO: 296 - protein, 9 aa, Unknown
  Description of Unknown: immunogenic epitope
TLDRNSLYV

SEQ ID NO: 297 - protein, 9 aa, Unknown
  Description of Unknown: immunogenic epitope
FLLSLALML

SEQ ID NO: 298 - protein, 9 aa, Unknown
  Description of Unknown: immunogenic epitope
NLGPWIQQV

SEQ ID NO: 299 - protein, 9 aa, Unknown
  Description of Unknown: immunogenic epitope
ILDSSEEDK

SEQ ID NO: 300 - protein, 10 aa, Unknown
  Description of Unknown: immunogenic epitope
YLPKSWTIQV

SEQ ID NO: 301 - protein, 12 aa, Unknown
  Description of Unknown: immunogenic epitope
WIHEQMERDLKT

SEQ ID NO: 302 - protein, 9 aa, Unknown
  Description of Unknown: immunogenic epitope
LLANAYIYV

SEQ ID NO: 303 - protein, 9 aa, Unknown
  Description of Unknown: immunogenic epitope
YLLCKAFGA

SEQ ID NO: 304 - protein, 9 aa, Unknown
  Description of Unknown: immunogenic epitope
KLSPYVHYT

SEQ ID NO: 305 - protein, 20 aa, Unknown
  Description of Unknown: immunogenic epitope
PDTRPAPGSTAPPAHGVTSA

SEQ ID NO: 306 - protein, 9 aa, Unknown
  Description of Unknown: immunogenic epitope
STAPPVHNV

SEQ ID NO: 307 - protein, 9 aa, Unknown
  Description of Unknown: immunogenic epitope
LLLLTVLTV

SEQ ID NO: 308 - protein, 12 aa, Unknown
  Description of Unknown: immunogenic epitope
PGSTAPPAHGVT

SEQ ID NO: 309 - protein, 9 aa, Unknown
  Description of Unknown: immunogenic epitope
MLAVISCAV

SEQ ID NO: 310 - protein, 9 aa, Unknown
  Description of Unknown: immunogenic epitope
RQKRILVNL

SEQ ID NO: 311 - protein, 9 aa, Unknown
  Description of Unknown: immunogenic epitope
NYNNFYRFL

SEQ ID NO: 312 - protein, 10 aa, Unknown
  Description of Unknown: immunogenic epitope
EYSKECLKEF

SEQ ID NO: 313 - protein, 9 aa, Unknown
  Description of Unknown: immunogenic epitope
EYLSLSDKI

SEQ ID NO: 314 - protein, 9 aa, Unknown
  Description of Unknown: immunogenic epitope
ELVRRILSR

SEQ ID NO: 315 - protein, 9 aa, Unknown
  Description of Unknown: immunogenic epitope
APRGVRMAV

SEQ ID NO: 316 - protein, 22 aa, Unknown
  Description of Unknown: immunogenic epitope
CLSRRPWKRSWSAGSCPGMPHL

SEQ ID NO: 317 - protein, 13 aa, Unknown
  Description of Unknown: immunogenic epitope
ILSRDAAPLPRPG

SEQ ID NO: 318 - protein, 9 aa, Unknown
  Description of Unknown: immunogenic epitope
EVDPASNTY

SEQ ID NO: 319 - protein, 10 aa, Unknown
  Description of Unknown: immunogenic epitope
GVYDGREHTV

SEQ ID NO: 320 - protein, 9 aa, Unknown
  Description of Unknown: immunogenic epitope
NYKRCFPVI

SEQ ID NO: 321 - protein, 8 aa, Unknown
  Description of Unknown: immunogenic epitope
SESLKMIF

SEQ ID NO: 322 - protein, 20 aa, Unknown
  Description of Unknown: immunogenic epitope
INKTSGPKRGKHAWTHRLRE

SEQ ID NO: 323 - protein, 20 aa, Unknown
  Description of Unknown: immunogenic epitope
YFSKKEWEKMKSSEKIVYVY

SEQ ID NO: 324 - protein, 20 aa, Unknown
  Description of Unknown: immunogenic epitope
MKLNYEVMTKLGFKVTLPPF

SEQ ID NO: 325 - protein, 20 aa, Unknown
  Description of Unknown: immunogenic epitope
KHAWTHRLRERKQLVVYEEI

SEQ ID NO: 326 - protein, 20 aa, Unknown
  Description of Unknown: immunogenic epitope
LGFKVTLPPFMRSKRAADFH

SEQ ID NO: 327 - protein, 20 aa, Unknown
  Description of Unknown: immunogenic epitope
KSSEKIVYVYMKLNYEVMTK

SEQ ID NO: 328 - protein, 9 aa, Unknown
  Description of Unknown: immunogenic epitope
SLGWLFLLL

SEQ ID NO: 329 - protein, 9 aa, Unknown
  Description of Unknown: immunogenic epitope
LSRLSNRLL

SEQ ID NO: 330 - protein, 9 aa, Unknown
  Description of Unknown: immunogenic epitope
TMNGSKSPV

SEQ ID NO: 331 - protein, 9 aa, Unknown
  Description of Unknown: immunogenic epitope
PLLENVISK

SEQ ID NO: 332 - protein, 9 aa, Unknown
  Description of Unknown: immunogenic epitope
SLSKILDTV

SEQ ID NO: 333 - protein, 9 aa, Unknown
  Description of Unknown: immunogenic epitope
AARAVFLAL

SEQ ID NO: 334 - protein, 9 aa, Unknown
  Description of Unknown: immunogenic epitope
EADPTGHSY

SEQ ID NO: 335 - protein, 9 aa, Unknown
  Description of Unknown: immunogenic epitope
KVLEYVIKV

SEQ ID NO: 336 - protein, 9 aa, Unknown
  Description of Unknown: immunogenic epitope
SLFRAVITK

SEQ ID NO: 337 - protein, 10 aa, Unknown
  Description of Unknown: immunogenic epitope
EVYDGREHSA

SEQ ID NO: 338 - protein, 9 aa, Unknown
  Description of Unknown: immunogenic epitope
RVRFFFPSL

SEQ ID NO: 339 - protein, 10 aa, Unknown
  Description of Unknown: immunogenic epitope
REPVTKAEML

SEQ ID NO: 340 - protein, 10 aa, Unknown
  Description of Unknown: immunogenic epitope
KEADPTGHSY

SEQ ID NO: 341 - protein, 9 aa, Unknown
  Description of Unknown: immunogenic epitope
DPARYEFLW

SEQ ID NO: 342 - protein, 11 aa, Unknown
  Description of Unknown: immunogenic epitope
ITKKVADLVGF

SEQ ID NO: 343 - protein, 9 aa, Unknown
  Description of Unknown: immunogenic epitope
SAFPTTINF

SEQ ID NO: 344 - protein, 9 aa, Unknown
  Description of Unknown: immunogenic epitope
SAYGEPRKL

SEQ ID NO: 345 - protein, 15 aa, Unknown
  Description of Unknown: immunogenic epitope
TSCILESLFRAVITK

SEQ ID NO: 346 - protein, 15 aa, Unknown
  Description of Unknown: immunogenic epitope
PRALAETSYVKVLEY

SEQ ID NO: 347 - protein, 16 aa, Unknown
  Description of Unknown: immunogenic epitope
FLLLKYRAREPVTKAE

SEQ ID NO: 348 - protein, 12 aa, Unknown
  Description of Unknown: immunogenic epitope
EYVIKVSARVRF

SEQ ID NO: 349 - protein, 10 aa, Unknown
  Description of Unknown: immunogenic epitope
YLQLVFGIEV

SEQ ID NO: 350 - protein, 9 aa, Unknown
  Description of Unknown: immunogenic epitope
EYLQLVFGI

SEQ ID NO: 351 - protein, 9 aa, Unknown
  Description of Unknown: immunogenic epitope
EGDCAPEEK

SEQ ID NO: 352 - protein, 14 aa, Unknown
  Description of Unknown: immunogenic epitope
LLKYRAREPVTKAE

SEQ ID NO: 353 - protein, 9 aa, Unknown
  Description of Unknown: immunogenic epitope
KASEKIFYV

SEQ ID NO: 354 - protein, 16 aa, Unknown
  Description of Unknown: immunogenic epitope
EKIQKAFDDIAKYFSK

SEQ ID NO: 355 - protein, 11 aa, Unknown
  Description of Unknown: immunogenic epitope
FGRLQGISPKI

SEQ ID NO: 356 - protein, 18 aa, Unknown
  Description of Unknown: immunogenic epitope
WEKMKASEKIFYVYMKRK

SEQ ID NO: 357 - protein, 15 aa, Unknown
  Description of Unknown: immunogenic epitope
KIFYVYMKRKYEAMT

SEQ ID NO: 358 - protein, 14 aa, Unknown
  Description of Unknown: immunogenic epitope
KIFYVYMKRKYEAM

SEQ ID NO: 359 - protein, 15 aa, Unknown
  Description of Unknown: immunogenic epitope
CEFHACWPAFTVLGE

SEQ ID NO: 360 - protein, 9 aa, Unknown
  Description of Unknown: immunogenic epitope
KFLDALISL

SEQ ID NO: 361 - protein, 10 aa, Unknown
  Description of Unknown: immunogenic epitope
ALGGHPLLGV

SEQ ID NO: 362 - protein, 9 aa, Unknown
  Description of Unknown: immunogenic epitope
LPRWPPPQL

SEQ ID NO: 363 - protein, 9 aa, Unknown
  Description of Unknown: immunogenic epitope
ILAKFLHWL

SEQ ID NO: 364 - protein, 9 aa, Unknown
  Description of Unknown: immunogenic epitope
RLVDDFLLV

SEQ ID NO: 365 - protein, 15 aa, Unknown
  Description of Unknown: immunogenic epitope
RPGLLGASVLGLDDI

SEQ ID NO: 366 - protein, 15 aa, Unknown
  Description of Unknown: immunogenic epitope
LTDLQPYMRQFVAHL

SEQ ID NO: 367 - protein, 9 aa, Unknown
  Description of Unknown: immunogenic epitope
VVVGAVGVG

SEQ ID NO: 368 - protein, 9 aa, Unknown
  Description of Unknown: immunogenic epitope
HLSTAFARV

SEQ ID NO: 369 - protein, 9 aa, Unknown
  Description of Unknown: immunogenic epitope
KIFGSLAFL

SEQ ID NO: 370 - protein, 9 aa, Unknown
  Description of Unknown: immunogenic epitope
IISAVVGIL

SEQ ID NO: 371 - protein, 9 aa, Unknown
  Description of Unknown: immunogenic epitope
ALCRWGLLL

SEQ ID NO: 372 - protein, 9 aa, Unknown
  Description of Unknown: immunogenic epitope
ILHNGAYSL

SEQ ID NO: 373 - protein, 9 aa, Unknown
  Description of Unknown: immunogenic epitope
RLLQETELV

SEQ ID NO: 374 - protein, 9 aa, Unknown
  Description of Unknown: immunogenic epitope
VVKGVVFGI

SEQ ID NO: 375 - protein, 10 aa, Unknown
  Description of Unknown: immunogenic epitope
YMIMVKCWMI

SEQ ID NO: 376 - protein, 9 aa, Unknown
  Description of Unknown: immunogenic epitope
SLLSGDWVL

SEQ ID NO: 377 - protein, 9 aa, Unknown
  Description of Unknown: immunogenic epitope
GLQLGVQAV

SEQ ID NO: 378 - protein, 9 aa, Unknown
  Description of Unknown: immunogenic epitope
PLTEYIQPV

SEQ ID NO: 379 - protein, 9 aa, Unknown
  Description of Unknown: immunogenic epitope
SPRWWPTCL

SEQ ID NO: 380 - protein, 9 aa, Unknown
  Description of Unknown: immunogenic epitope
GVALQTMKQ

SEQ ID NO: 381 - protein, 9 aa, Unknown
  Description of Unknown: immunogenic epitope
FMNKFIYEI

SEQ ID NO: 382 - protein, 10 aa, Unknown
  Description of Unknown: immunogenic epitope
QLAVSVILRV

SEQ ID NO: 383 - protein, 14 aa, Unknown
  Description of Unknown: immunogenic epitope
LPAVVGLSPGEQEY

SEQ ID NO: 384 - protein, 9 aa, Unknown
  Description of Unknown: immunogenic epitope
NYARTEDFF

SEQ ID NO: 385 - protein, 9 aa, Unknown
  Description of Unknown: immunogenic epitope
FLIIWQNTM

SEQ ID NO: 386 - protein, 14 aa, Unknown
  Description of Unknown: immunogenic epitope
TLYQDDTLTLQAAG

SEQ ID NO: 387 - protein, 10 aa, Unknown
  Description of Unknown: immunogenic epitope
SLYKFSPFPL

SEQ ID NO: 388 - protein, 9 aa, Unknown
  Description of Unknown: immunogenic epitope
KELEGILLL

SEQ ID NO: 389 - protein, 9 aa, Unknown
  Description of Unknown: immunogenic epitope
RLSSCVPVA

SEQ ID NO: 390 - protein, 10 aa, Unknown
  Description of Unknown: immunogenic epitope
VLLQAGSLHA

SEQ ID NO: 391 - protein, 9 aa, Unknown
  Description of Unknown: immunogenic epitope
LLNAFTVTV

SEQ ID NO: 392 - protein, 8 aa, Unknown
  Description of Unknown: immunogenic epitope
VLFYLGQY

SEQ ID NO: 393 - protein, 10 aa, Unknown
  Description of Unknown: immunogenic epitope
FIASNGVKLV

SEQ ID NO: 394 - protein, 9 aa, Unknown
  Description of Unknown: immunogenic epitope
ETVSEQSNV

SEQ ID NO: 395 - protein, 9 aa, Unknown
  Description of Unknown: immunogenic epitope
FLDEFMEGV

SEQ ID NO: 396 - protein, 8 aa, Unknown
  Description of Unknown: immunogenic epitope
QQITKTEV

SEQ ID NO: 397 - protein, 8 aa, Unknown
  Description of Unknown: immunogenic epitope
YRPRPRRY

SEQ ID NO: 398 - protein, 9 aa, Unknown
  Description of Unknown: immunogenic epitope
MVKISGGPR

SEQ ID NO: 399 - protein, 9 aa, Unknown
  Description of Unknown: immunogenic epitope
EVDPIGHVY

SEQ ID NO: 400 - protein, 9 aa, Unknown
  Description of Unknown: immunogenic epitope
ISGGPRISY

SEQ ID NO: 401 - protein, 9 aa, Unknown
  Description of Unknown: immunogenic epitope
RQKKIRIQL

SEQ ID NO: 402 - protein, 16 aa, Unknown
  Description of Unknown: immunogenic epitope
HLGSRQKKIRIQLRSQ

SEQ ID NO: 403 - protein, 17 aa, Unknown
  Description of Unknown: immunogenic epitope
CATWKVICKSCISQTPG

SEQ ID NO: 404 - protein, 9 aa, Unknown
  Description of Unknown: immunogenic epitope
TYLPTNASL

SEQ ID NO: 405 - protein, 9 aa, Unknown
  Description of Unknown: immunogenic epitope
MIAVFLPIV

SEQ ID NO: 406 - protein, 15 aa, Unknown
  Description of Unknown: immunogenic epitope
HQQYFYKIPILVINK

SEQ ID NO: 407 - protein, 9 aa, Unknown
  Description of Unknown: immunogenic epitope
FLFLLFFWL

SEQ ID NO: 408 - protein, 9 aa, Unknown
  Description of Unknown: immunogenic epitope
TLMSAMTNL

SEQ ID NO: 409 - protein, 9 aa, Unknown
  Description of Unknown: immunogenic epitope
ALDVYNGLL

SEQ ID NO: 410 - protein, 10 aa, Unknown
  Description of Unknown: immunogenic epitope
FLTPKKLQCV

SEQ ID NO: 411 - protein, 10 aa, Unknown
  Description of Unknown: immunogenic epitope
VISNDVCAQV

SEQ ID NO: 412 - protein, 9 aa, Unknown
  Description of Unknown: immunogenic epitope
YYWPRPRRY

SEQ ID NO: 413 - protein, 9 aa, Unknown
  Description of Unknown: immunogenic epitope
NTYASPRFK

SEQ ID NO: 414 - protein, 10 aa, Unknown
  Description of Unknown: immunogenic epitope
SLFEGIDIYT

SEQ ID NO: 415 - protein, 9 aa, Unknown
  Description of Unknown: immunogenic epitope
ALSVMGVYV

SEQ ID NO: 416 - protein, 8 aa, Unknown
  Description of Unknown: immunogenic epitope
GLQLGVQA

SEQ ID NO: 417 - protein, 15 aa, Unknown
  Description of Unknown: immunogenic epitope
YSVYFNLPADTIYTN

SEQ ID NO: 418 - protein, 29 aa, Unknown
  Description of Unknown: immunogenic epitope
EDLTVKIGDFGLATEKSRWSGSHQFEQLS

SEQ ID NO: 419 - protein, 9 aa, Unknown
  Description of Unknown: immunogenic epitope
SYLDSGIHF

SEQ ID NO: 420 - protein, 12 aa, Unknown
  Description of Unknown: immunogenic epitope
FSWAMDLDPKGA

SEQ ID NO: 421 - protein, 10 aa, Unknown
  Description of Unknown: immunogenic epitope
ACDPHSGHFV

SEQ ID NO: 422 - protein, 9 aa, Unknown
  Description of Unknown: immunogenic epitope
CILGKLFTK

SEQ ID NO: 423 - protein, 9 aa, Unknown
  Description of Unknown: immunogenic epitope
AVCPWTWLR

SEQ ID NO: 424 - protein, 9 aa, Unknown
  Description of Unknown: immunogenic epitope
ILDKVLVHL

SEQ ID NO: 425 - protein, 9 aa, Unknown
  Description of Unknown: immunogenic epitope
GLFGDIYLA

SEQ ID NO: 426 - protein, 14 aa, Unknown
  Description of Unknown: immunogenic epitope
MIFEKHGFRRTTPP

SEQ ID NO: 427 - protein, 10 aa, Unknown
  Description of Unknown: immunogenic epitope
SLADEAEVYL

SEQ ID NO: 428 - protein, 10 aa, Unknown
  Description of Unknown: immunogenic epitope
TLDWLLQTPK

SEQ ID NO: 429 - protein, 9 aa, Unknown
  Description of Unknown: immunogenic epitope
ILNAMIAKI

SEQ ID NO: 430 - protein, 9 aa, Unknown
  Description of Unknown: immunogenic epitope
WRRAPAPGA

SEQ ID NO: 431 - protein, 9 aa, Unknown
  Description of Unknown: immunogenic epitope
PVTWRRAPA

SEQ ID NO: 432 - protein, 11 aa, Unknown
  Description of Unknown: immunogenic epitope
FLEGNEVGKTY

SEQ ID NO: 433 - protein, 9 aa, Unknown
  Description of Unknown: immunogenic epitope
KTLTSVFQK

SEQ ID NO: 434 - protein, 9 aa, Unknown
  Description of Unknown: immunogenic epitope
EEKLIVVLF

SEQ ID NO: 435 - protein, 11 aa, Unknown
  Description of Unknown: immunogenic epitope
SELFRSGLDSY

SEQ ID NO: 436 - protein, 9 aa, Unknown
  Description of Unknown: immunogenic epitope
FRSGLDSYV

SEQ ID NO: 437 - protein, 9 aa, Unknown
  Description of Unknown: immunogenic epitope
EAFIQPITR

SEQ ID NO: 438 - protein, 11 aa, Unknown
  Description of Unknown: immunogenic epitope
RVIKNSIRLTL

SEQ ID NO: 439 - protein, 9 aa, Unknown
  Description of Unknown: immunogenic epitope
KINKNPKYK

SEQ ID NO: 440 - protein, 9 aa, Unknown
  Description of Unknown: immunogenic epitope
YTDFHCQYV

SEQ ID NO: 441 - protein, 10 aa, Unknown
  Description of Unknown: immunogenic epitope
LLLDDLLVSI

SEQ ID NO: 442 - protein, 16 aa, Unknown
  Description of Unknown: immunogenic epitope
PYYFAAELPPRNLPEP

SEQ ID NO: 443 - protein, 10 aa, Unknown
  Description of Unknown: immunogenic epitope
ILDTAGREEY

SEQ ID NO: 444 - protein, 9 aa, Unknown
  Description of Unknown: immunogenic epitope
RPHVPESAF

SEQ ID NO: 445 - protein, 9 aa, Unknown
  Description of Unknown: immunogenic epitope
KIFSEVTLK

SEQ ID NO: 446 - protein, 9 aa, Unknown
  Description of Unknown: immunogenic epitope
SHETVIIEL

SEQ ID NO: 447 - protein, 15 aa, Unknown
  Description of Unknown: immunogenic epitope
GELIGILNAAKVPAD

SEQ ID NO: 448 - protein, 9 aa, Unknown
  Description of Unknown: immunogenic epitope
LYSACFWWL

SEQ ID NO: 449 - protein, 9 aa, Unknown
  Description of Unknown: immunogenic epitope
VLHWDPETV

SEQ ID NO: 450 - protein, 9 aa, Unknown
  Description of Unknown: immunogenic epitope
MSLQRQFLR

SEQ ID NO: 451 - protein, 20 aa, Unknown
  Description of Unknown: immunogenic epitope
ISPNSVFSQWRVVCDSLEDY

SEQ ID NO: 452 - protein, 10 aa, Unknown
  Description of Unknown: immunogenic epitope
SLPYWNFATG

SEQ ID NO: 453 - protein, 15 aa, Unknown
  Description of Unknown: immunogenic epitope
SQWRVVCDSLEDYDT

SEQ ID NO: 454 - protein, 9 aa, Unknown
  Description of Unknown: immunogenic epitope
SVYDFFVWL

SEQ ID NO: 455 - protein, 9 aa, Unknown
  Description of Unknown: immunogenic epitope
TLDSQVMSL

SEQ ID NO: 456 - protein, 9 aa, Unknown
  Description of Unknown: immunogenic epitope
LLGPGRPYR

SEQ ID NO: 457 - protein, 9 aa, Unknown
  Description of Unknown: immunogenic epitope
ANDPIFVVL

SEQ ID NO: 458 - protein, 15 aa, Unknown
  Description of Unknown: immunogenic epitope
QCTEVRADTRPWSGP

SEQ ID NO: 459 - protein, 10 aa, Unknown
  Description of Unknown: immunogenic epitope
ALPYWNFATG

SEQ ID NO: 460 - protein, 9 aa, Unknown
  Description of Unknown: immunogenic epitope
KCDICTDEY

SEQ ID NO: 461 - protein, 11 aa, Unknown
  Description of Unknown: immunogenic epitope
SSDYVIPIGTY

SEQ ID NO: 462 - protein, 9 aa, Unknown
  Description of Unknown: immunogenic epitope
MLLAVLYCL

SEQ ID NO: 463 - protein, 10 aa, Unknown
  Description of Unknown: immunogenic epitope
CLLWSFQTSA

SEQ ID NO: 464 - protein, 9 aa, Unknown
  Description of Unknown: immunogenic epitope
YMDGTMSQV

SEQ ID NO: 465 - protein, 11 aa, Unknown
  Description of Unknown: immunogenic epitope
IYMDGTADFSF

SEQ ID NO: 466 - protein, 9 aa, Unknown
  Description of Unknown: immunogenic epitope
QCSGNFMGF

SEQ ID NO: 467 - protein, 12 aa, Unknown
  Description of Unknown: immunogenic epitope
TPRLPSSADVEF

SEQ ID NO: 468 - protein, 9 aa, Unknown
  Description of Unknown: immunogenic epitope
LPSSADVEF

SEQ ID NO: 469 - protein, 10 aa, Unknown
  Description of Unknown: immunogenic epitope
LHHAFVDSIF

SEQ ID NO: 470 - protein, 9 aa, Unknown
  Description of Unknown: immunogenic epitope
SEIWRDIDF

SEQ ID NO: 471 - protein, 15 aa, Unknown
  Description of Unknown: immunogenic epitope
QNILLSNAPLGPQFP

SEQ ID NO: 472 - protein, 21 aa, Unknown [sequence omitted]

SEQ ID NO: 473 - protein, 30 aa, Unknown
  Description of Unknown: immunogenic epitope
YTTAEEAAGIGILTVILGVLLLIGCWYCRR

SEQ ID NO: 474 - protein, 9 aa, Unknown
  Description of Unknown: immunogenic epitope
ALNFPGSQK

SEQ ID NO: 475 - protein, 9 aa, Unknown
  Description of Unknown: immunogenic epitope
VYFFLPDHL

SEQ ID NO: 476 - protein, 9 aa, Unknown
  Description of Unknown: immunogenic epitope
RTKQLYPEW

SEQ ID NO: 477 - protein, 10 aa, Unknown
  Description of Unknown: immunogenic epitope
HTMEVTVYHR

SEQ ID NO: 478 - protein, 9 aa, Unknown
  Description of Unknown: immunogenic epitope
SSPGCQPPA

SEQ ID NO: 479 - protein, 10 aa, Unknown
  Description of Unknown: immunogenic epitope
VPLDCVLYRY

SEQ ID NO: 480 - protein, 9 aa, Unknown
  Description of Unknown: immunogenic epitope
LPHSSSHWL

SEQ ID NO: 481 - protein, 8 aa, Unknown
  Description of Unknown: immunogenic epitope
SNDGPTLI

SEQ ID NO: 482 - protein, 15 aa, Unknown
  Description of Unknown: immunogenic epitope
GRAMLGTHTMEVTVY

SEQ ID NO: 483 - protein, 16 aa, Unknown
  Description of Unknown: immunogenic epitope
WNRQLYPEWTEAQRLD

SEQ ID NO: 484 - protein, 18 aa, Unknown
  Description of Unknown: immunogenic epitope
TTEWVETTARELPIPEPE

SEQ ID NO: 485 - protein, 17 aa, Unknown
  Description of Unknown: immunogenic epitope
TGRAMLGTHTMEVTVYH

SEQ ID NO: 486 - protein, 10 aa, Unknown
  Description of Unknown: immunogenic epitope
VLPDVFIRCV

SEQ ID NO: 487 - protein, 10 aa, Unknown
  Description of Unknown: immunogenic epitope
RYCNLEGPPI

SEQ ID NO: 488 - protein, 24 aa, Unknown
  Description of Unknown: immunogenic epitope
KWTEPYCVIAAVKIFPRFFMVAKQ

SEQ ID NO: 489 - protein, 20 aa, Unknown
  Description of Unknown: immunogenic epitope
KCCKIRYCNLEGPPINSSVF

SEQ ID NO: 490 - protein, 9 aa, Unknown
  Description of Unknown: immunogenic epitope
GLYDGMEHL

SEQ ID NO: 491 - protein, 9 aa, Unknown
  Description of Unknown: immunogenic epitope
FLWGPRALV

SEQ ID NO: 492 - protein, 9 aa, Unknown
  Description of Unknown: immunogenic epitope
VRIGHLYIL

SEQ ID NO: 493 - protein, 15 aa, Unknown
  Description of Unknown: immunogenic epitope
REPFTKAEMLGSVIR

SEQ ID NO: 494 - protein, 14 aa, Unknown
  Description of Unknown: immunogenic epitope
AELVHFLLLKYRAR

SEQ ID NO: 495 - protein, 10 aa, Unknown
  Description of Unknown: immunogenic epitope
LLFGLALIEV

SEQ ID NO: 496 - protein, 9 aa, Unknown
  Description of Unknown: immunogenic epitope
ALKDVEERV

SEQ ID NO: 497 - protein, 9 aa, Unknown
  Description of Unknown: immunogenic epitope
SESIKKKVL

SEQ ID NO: 498 - protein, 9 aa, Unknown
  Description of Unknown: immunogenic epitope
ASSTLYLVF

SEQ ID NO: 499 - protein, 15 aa, Unknown
  Description of Unknown: immunogenic epitope
SSTLYLVFSPSSFST

SEQ ID NO: 500 - protein, 9 aa, Unknown
  Description of Unknown: immunogenic epitope
QGQHFLQKV

SEQ ID NO: 501 - protein, 10 aa, Unknown
  Description of Unknown: immunogenic epitope
EVISCKLIKR

SEQ ID NO: 502 - protein, 9 aa, Unknown
  Description of Unknown: immunogenic epitope
FPSDSWCYF

SEQ ID NO: 503 - protein, 9 aa, Unknown
  Description of Unknown: immunogenic epitope
LYATVIHDI

SEQ ID NO: 504 - protein, 9 aa, Unknown
  Description of Unknown: immunogenic epitope
SSKALQRPV

SEQ ID NO: 505 - protein, 9 aa, Unknown
  Description of Unknown: immunogenic epitope
GFKQSSKAL

SEQ ID NO: 506 - protein, 17 aa, Unknown
  Description of Unknown: immunogenic epitope
ATGFKQSSKALQRPVAS

SEQ ID NO: 507 - protein, 16 aa, Unknown
  Description of Unknown: immunogenic epitope
TMKQICKKEIRRLHQY

SEQ ID NO: 508 - protein, 10 aa, Unknown
  Description of Unknown: immunogenic epitope
KILDAVVAQK

SEQ ID NO: 509 - protein, 9 aa, Unknown
  Description of Unknown: immunogenic epitope
RIAECILGM

SEQ ID NO: 510 - protein, 15 aa, Unknown
  Description of Unknown: immunogenic epitope
IGRIAECILGMNPSR

SEQ ID NO: 511 - protein, 10 aa, Unknown
  Description of Unknown: immunogenic epitope
YVDFREYEYY

SEQ ID NO: 512 - protein, 9 aa, Unknown
  Description of Unknown: immunogenic epitope
FLDRFLSCM

SEQ ID NO: 513 - protein, 11 aa, Unknown
  Description of Unknown: immunogenic epitope
SLIAAAAFCLA

SEQ ID NO: 514 - protein, 9 aa, Unknown
  Description of Unknown: immunogenic epitope
VVMSWAPPV

SEQ ID NO: 515 - protein, 25 aa, Unknown
  Description of Unknown: immunogenic epitope
NSNHVASGAGEAAIETQSSSSEEIV

SEQ ID NO: 516 - protein, 10 aa, Unknown
  Description of Unknown: immunogenic epitope
ILFGISLREV

SEQ ID NO: 517 - protein, 9 aa, Unknown
  Description of Unknown: immunogenic epitope
KVVEFLAML

SEQ ID NO: 518 - protein, 13 aa, Unknown
  Description of Unknown: immunogenic epitope
SSALLSIFQSSPE

SEQ ID NO: 519 - protein, 9 aa, Unknown
  Description of Unknown: immunogenic epitope
SFSYTLLSL

SEQ ID NO: 520 - protein, 9 aa, Unknown
  Description of Unknown: immunogenic epitope
VSSFFSYTL

SEQ ID NO: 521 - protein, 15 aa, Unknown
  Description of Unknown: immunogenic epitope
KPLFRRMSSLELVIA

SEQ ID NO: 522 - protein, 512 aa, Vaccinia virus; identical to SEQ ID NO: 23

SEQ ID NO: 523 - protein, 512 aa, Vaccinia virus; identical to SEQ ID NO: 23

SEQ ID NO: 524 - protein, 512 aa, Vaccinia virus; identical to SEQ ID NO: 58

SEQ ID NO: 525 - protein, 506 aa, Vaccinia virus; identical to SEQ ID NO: 74

SEQ ID NO: 526 - protein, 512 aa, Vaccinia virus; identical to SEQ ID NO: 92

SEQ ID NO: 527 - protein, 224 aa, Vaccinia virus; identical to SEQ ID NO: 24

SEQ ID NO: 528 - protein, 229 aa, Vaccinia virus; identical to SEQ ID NO: 42

SEQ ID NO: 529 - protein, 224 aa, Vaccinia virus; identical to SEQ ID NO: 59

SEQ ID NO: 530 - protein, 224 aa, Vaccinia virus; identical to SEQ ID NO: 75

SEQ ID NO: 531 - protein, 224 aa, Vaccinia virus; identical to SEQ ID NO: 93

SEQ ID NO: 532 - protein, 117 aa, Vaccinia virus; identical to SEQ ID NO: 25

SEQ ID NO: 533 - protein, 117 aa, Vaccinia virus; identical to SEQ ID NO: 43

SEQ ID NO: 534 - protein, 117 aa, Vaccinia virus; identical to SEQ ID NO: 25

SEQ ID NO: 535 - protein, 117 aa, Vaccinia virus; identical to SEQ ID NO: 25

SEQ ID NO: 536 - protein, 117 aa, Vaccinia virus; identical to SEQ ID NO: 25

SEQ ID NO: 537 - protein, 175 aa, Vaccinia virus; identical to SEQ ID NO: 26

SEQ ID NO: 538 - protein, 175 aa, Vaccinia virus; identical to SEQ ID NO: 44

SEQ ID NO: 539 - protein, 79 aa, Vaccinia virus; identical to SEQ ID NO: 61

SEQ ID NO: 540 - protein, 175 aa, Vaccinia virus; identical to SEQ ID NO: 77

SEQ ID NO: 541 - protein, 175 aa, Vaccinia virus; identical to SEQ ID NO: 95

SEQ ID NO: 542 - protein, 472 aa, Vaccinia virus; identical to SEQ ID NO: 27

SEQ ID NO: 543 - protein, 472 aa, Vaccinia virus; identical to SEQ ID NO: 45

SEQ ID NO: 544 - protein, 472 aa, Vaccinia virus; identical to SEQ ID NO: 62

SEQ ID NO: 545 - protein, 161 aa, Vaccinia virus; identical to SEQ ID NO: 80

SEQ ID NO: 546 - protein, 470 aa, Vaccinia virus; identical to SEQ ID NO: 96

SEQ ID NO: 547 - protein, 220 aa, Vaccinia virus; identical to SEQ ID NO: 28

SEQ ID NO: 548 - protein, 220 aa, Vaccinia virus; identical to SEQ ID NO: 46

SEQ ID NO: 549 - protein, 196 aa, Vaccinia virus; identical to SEQ ID NO: 63

SEQ ID NO: 550 - protein, 220 aa, Vaccinia virus; identical to SEQ ID NO: 28

SEQ ID NO: 551 - protein, 220 aa, Vaccinia virus; identical to SEQ ID NO: 28

SEQ ID NO: 552 - protein, 284 aa, Vaccinia virus; identical to SEQ ID NO: 29

SEQ ID NO: 553 - protein, 284 aa, Vaccinia virus; identical to SEQ ID NO: 47

SEQ ID NO: 554 - protein, 189 aa, Vaccinia virus; identical to SEQ ID NO: 65

SEQ ID NO: 555 - protein, 284 aa, Vaccinia virus; identical to SEQ ID NO: 82

SEQ ID NO: 556 - protein, 284 aa, Vaccinia virus; identical to SEQ ID NO: 98

SEQ ID NO: 557 - protein, 369 aa, Vaccinia virus; identical to SEQ ID NO: 30

SEQ ID NO: 558 - protein, 369 aa, Vaccinia virus; identical to SEQ ID NO: 48

SEQ ID NO: 559 - protein, 368 aa, Vaccinia virus; identical to SEQ ID NO: 66

SEQ ID NO: 560 - protein, 364 aa, Vaccinia virus; identical to SEQ ID NO: 83

SEQ ID NO: 561 - protein, 309 aa, Vaccinia virus; identical to SEQ ID NO: 99

SEQ ID NO: 562 - protein, 81 aa, Vaccinia virus; identical to SEQ ID NO: 31

SEQ ID NO: 563 - protein, 81 aa, Vaccinia virus; identical to SEQ ID NO: 67

SEQ ID NO: 564 - protein, 88 aa, Vaccinia virus; identical to SEQ ID NO: 33

SEQ ID NO: 565 - protein, 88 aa, Vaccinia virus; identical to SEQ ID NO: 49

SEQ ID NO: 566 - protein, 88 aa, Vaccinia virus; identical to SEQ ID NO: 33

SEQ ID NO: 567 - protein, 88 aa, Vaccinia virus; identical to SEQ ID NO: 84

SEQ ID NO: 568 - protein, 88 aa, Vaccinia virus; identical to SEQ ID NO: 100

SEQ ID NO: 569 - protein, 424 aa, Vaccinia virus; identical to SEQ ID NO: 34

SEQ ID NO: 570 - protein, 424 aa, Vaccinia virus; identical to SEQ ID NO: 50

SEQ ID NO: 571 - protein, 424 aa, Vaccinia virus; identical to SEQ ID NO: 85

SEQ ID NO: 572 - protein, 424 aa, Vaccinia virus; identical to SEQ ID NO: 85

SEQ ID NO: 573 - protein, 135 aa, Vaccinia virus; identical to SEQ ID NO: 35

SEQ ID NO: 574 - protein, 134 aa, Vaccinia virus; identical to SEQ ID NO: 52

SEQ ID NO: 575 - protein, 134 aa, Vaccinia virus; identical to SEQ ID NO: 52

SEQ ID NO: 576 - protein, 171 aa, Vaccinia virus; identical to SEQ ID NO: 86

SEQ ID NO: 577 - protein, 175 aa, Vaccinia virus; identical to SEQ ID NO: 102

SEQ ID NO: 578 - protein, 81 aa, Vaccinia virus; identical to SEQ ID NO: 36

SEQ ID NO: 579 - protein, 81 aa, Vaccinia virus; identical to SEQ ID NO: 36

SEQ ID NO: 580 - protein, 81 aa, Vaccinia virus; identical to SEQ ID NO: 36

SEQ ID NO: 581 - protein, 81 aa, Vaccinia virus; identical to SEQ ID NO: 36

SEQ ID NO: 582 - protein, 149 aa, Vaccinia virus; identical to SEQ ID NO: 37

SEQ ID NO: 583 - protein, 149 aa, Vaccinia virus; identical to SEQ ID NO: 37

SEQ ID NO: 584 - protein, 149 aa, Vaccinia virus; identical to SEQ ID NO: 37

SEQ ID NO: 585 - protein, 149 aa, Vaccinia virus; identical to SEQ ID NO: 37

SEQ ID NO: 586 - protein, 149 aa, Vaccinia virus; identical to SEQ ID NO: 37

SEQ ID NO: 587 - protein, 226 aa, Vaccinia virus; identical to SEQ ID NO: 38

SEQ ID NO: 588 - protein, 226 aa, Vaccinia virus; identical to SEQ ID NO: 55

SEQ ID NO: 589 - protein, 226 aa, Vaccinia virus; identical to SEQ ID NO: 71

SEQ ID NO: 590 - protein, 226 aa, Vaccinia virus; identical to SEQ ID NO: 89

SEQ ID NO: 591 - protein, 226 aa, Vaccinia virus; identical to SEQ ID NO: 38

SEQ ID NO: 592 - protein, 147 aa, Vaccinia virus; identical to SEQ ID NO: 39

SEQ ID NO: 593 - protein, 147 aa, Vaccinia virus; identical to SEQ ID NO: 56

SEQ ID NO: 594 - protein, 147 aa, Vaccinia virus; identical to SEQ ID NO: 72

SEQ ID NO: 595 - protein, 147 aa, Vaccinia virus; identical to SEQ ID NO: 39

SEQ ID NO: 596 - protein, 147 aa, Vaccinia virus; identical to SEQ ID NO: 106

SEQ ID NO: 597 - protein, 480 aa, Vaccinia virus; identical to SEQ ID NO: 40

SEQ ID NO: 598 - protein, 480 aa, Vaccinia virus; identical to SEQ ID NO: 57

SEQ ID NO: 599 - protein, 480 aa, Vaccinia virus; identical to SEQ ID NO: 73

SEQ ID NO: 600 - protein, 480 aa, Vaccinia virus; identical to SEQ ID NO: 73

SEQ ID NO: 601 - protein, 480 aa, Vaccinia virus; identical to SEQ ID NO: 107

SEQ ID NO: 602 - protein, 222 aa, Vaccinia virus; identical to SEQ ID NO: 108

SEQ ID NO: 603 - protein, 345 aa, Vaccinia virus; identical to SEQ ID NO: 127

SEQ ID NO: 604 - protein, 222 aa, Vaccinia virus; identical to SEQ ID NO: 151

SEQ ID NO: 605 - protein, 222 aa, Vaccinia virus; identical to SEQ ID NO: 163

SEQ ID NO: 606 - protein, 149 aa, Vaccinia virus; identical to SEQ ID NO: 109

SEQ ID NO: 607 - protein, 149 aa, Vaccinia virus; identical to SEQ ID NO: 128

SEQ ID NO: 608 - protein, 149 aa, Vaccinia virus; identical to SEQ ID NO: 109

SEQ ID NO: 609 - protein, 149 aa, Vaccinia virus; identical to SEQ ID NO: 164

SEQ ID NO: 610 - protein, 149 aa, Vaccinia virus; identical to SEQ ID NO: 109

SEQ ID NO: 611 - protein, 91 aa, Vaccinia virus; identical to SEQ ID NO: 110

SEQ ID NO: 612 - protein, 91 aa, Vaccinia virus; identical to SEQ ID NO: 110

SEQ ID NO: 613 - protein, 326 aa, Vaccinia virus; identical to SEQ ID NO: 111
  MOD_RES (31)..(31): Any amino acid

SEQ ID NO: 614 - protein, 326 aa, Vaccinia virus; identical to SEQ ID NO: 129

SEQ ID NO: 615 - protein, 289 aa, Vaccinia virus
MELENEPVILPCPQINTLSSGYNILDILWEKRGADNDRIIPIDNGSNMLILNPTQSDSGIYICITTNETYCDMMSLNLTIVSVLESNIDLISYPQIVNERSTGEMVCPNINAFIASNVNADIIWSGHRRLRNKRLKQRTPGIITIEDVRKNDAGYYTCVLEYIYRGKTYNVTRIVKLEVRDKIIPSTMQLPDGIVTSIGSNLTIACRVSLRPPTTDADVFWISNGMYYEEDDGDGNGRISVANKIYMTDKRRVITSRLNINPVKEEDATTFTCMAFTIPSISKTVTVSI

SEQ ID NO: 616 - protein, 326 aa, Vaccinia virus; identical to SEQ ID NO: 165

SEQ ID NO: 617 - protein, 326 aa, Vaccinia virus; identical to SEQ ID NO: 201

SEQ ID NO: 618 - protein, 75 aa, Vaccinia virus; identical to SEQ ID NO: 112

SEQ ID NO: 619 - protein, 75 aa, Vaccinia virus; identical to SEQ ID NO: 155

SEQ ID NO: 620 - protein, 340 aa, Vaccinia virus; identical to SEQ ID NO: 113

SEQ ID NO: 621 - protein, 340 aa, Vaccinia virus; identical to SEQ ID NO: 130

SEQ ID NO: 622 - protein, 340 aa, Vaccinia virus; identical to SEQ ID NO: 156

SEQ ID NO: 623 - protein, 340 aa, Vaccinia virus; identical to SEQ ID NO: 166

SEQ ID NO: 624 - protein, 340 aa, Vaccinia virus; identical to SEQ ID NO: 202

SEQ ID NO: 625 - protein, 574 aa, Vaccinia virus; identical to SEQ ID NO: 114

SEQ ID NO: 626 - protein, 574 aa, Vaccinia virus; identical to SEQ ID NO: 131

SEQ ID NO: 627 - protein, 574 aa, Vaccinia virus; identical to SEQ ID NO: 157

SEQ ID NO: 628 - protein, 574 aa, Vaccinia virus; identical to SEQ ID NO: 167

SEQ ID NO: 629 - protein, 353 aa, Vaccinia virus; identical to SEQ ID NO: 115

SEQ ID NO: 630 - protein, 351 aa, Vaccinia virus; identical to SEQ ID NO: 132

SEQ ID NO: 631 - protein, 353 aa, Vaccinia virus; identical to SEQ ID NO: 158

SEQ ID NO: 632 - protein, 265 aa, Vaccinia virus; identical to SEQ ID NO: 168

SEQ ID NO: 633 - protein, 91 aa, Vaccinia virus; identical to SEQ ID NO: 117

SEQ ID NO: 634 - protein, 87 aa, Vaccinia virus; identical to SEQ ID NO: 184

SEQ ID NO: 635 - protein, 181 aa, Vaccinia virus; identical to SEQ ID NO: 118

SEQ ID NO: 636 - protein, 181 aa, Vaccinia virus; identical to SEQ ID NO: 185

SEQ ID NO: 637 - protein, 147 aa, Vaccinia virus; identical to SEQ ID NO: 205

SEQ ID NO: 638 - protein, 386 aa, Vaccinia virus; identical to SEQ ID NO: 119

SEQ ID NO: 639 - protein, 382 aa, Vaccinia virus; identical to SEQ ID NO: 186

SEQ ID NO: 640 - protein, 150 aa, Vaccinia virus; identical to SEQ ID NO: 120

SEQ ID NO: 641 - protein, 198 aa, Vaccinia virus; identical to SEQ ID NO: 187

SEQ ID NO: 642 - protein, 259 aa, Vaccinia virus; identical to SEQ ID NO: 122

SEQ ID NO: 643 - protein, 112 aa, Vaccinia virus; identical to SEQ ID NO: 143

SEQ ID NO: 644 - protein, 147 aa, Vaccinia virus; identical to SEQ ID NO: 188

SEQ ID NO: 645 - protein, 103 aa, Vaccinia virus; identical to SEQ ID NO: 123

SEQ ID NO: 646 - protein, 109 aa, Vaccinia virus; identical to SEQ ID NO: 144

SEQ ID NO: 647 - protein, 128 aa, Vaccinia virus; identical to SEQ ID NO: 189

SEQ ID NO: 648 - protein, 128 aa, Vaccinia virus; identical to SEQ ID NO: 189

SEQ ID NO: 649 - protein, 113 aa, Vaccinia virus; identical to SEQ ID NO: 124

SEQ ID NO: 650 - protein, 64 aa, Vaccinia virus; identical to SEQ ID NO: 145

SEQ ID NO: 651 - protein, 111 aa, Vaccinia virus; identical to SEQ ID NO: 190

SEQ ID NO: 652 - protein, 64 aa, Vaccinia virus; identical to SEQ ID NO: 145

SEQ ID NO: 653 - protein, 122 aa, Vaccinia virus; identical to SEQ ID NO: 125

SEQ ID NO: 654 - protein, 122 aa, Vaccinia virus; identical to SEQ ID NO: 147

SEQ ID NO: 655 - protein, 93 aa, Vaccinia virus
MHHPMESVKTTNTNAIICVREHTLPDYANTQCTPCGSGTFTSRNNHLPACLSCNGRRDRVTLLTIESVNALPDIIVFSKDHPDARHVFPKQNV

SEQ ID NO: 656 - protein, 244 aa, Vaccinia virus; identical to SEQ ID NO: 126

SEQ ID NO: 657 - protein, 244 aa, Vaccinia virus; identical to SEQ ID NO: 150

SEQ ID NO: 658 - protein, 244 aa, Vaccinia virus; identical to SEQ ID NO: 150

SEQ ID NO: 659 - protein, 241 aa, Vaccinia virus; identical to SEQ ID NO: 192

SEQ ID NO: 660 - protein, 258 aa, Vaccinia virus; identical to SEQ ID NO: 208

SEQ ID NO: 661 - protein, 13 aa, Unknown
  Description of Unknown: immunogenic epitope
SYLQDSDPDSFQD

SEQ ID NO: 662 - protein, 9 aa, Unknown
  Description of Unknown: immunogenic epitope
EVDPIGHLY

SEQ ID NO: 663 - protein, 9 aa, Unknown
  Description of Unknown: immunogenic epitope
KVAELVHFL

SEQ ID NO: 664 - protein, 9 aa, Unknown
  Description of Unknown: immunogenic epitope
TFPDLESEF

SEQ ID NO: 665 - protein, 9 aa, Unknown
  Description of Unknown: immunogenic epitope
VAELVHFLL

SEQ ID NO: 666 - protein, 10 aa, Unknown
  Description of Unknown: immunogenic epitope
MEVDPIGHLY

SEQ ID NO: 667 - protein, 9 aa, Unknown
  Description of Unknown: immunogenic epitope
AELVHFLLL

SEQ ID NO: 668 - protein, 9 aa, Unknown
  Description of Unknown: immunogenic epitope
WQYFFPVIF

SEQ ID NO: 669 - protein, 16 aa, Unknown
  Description of Unknown: immunogenic epitope
KKLLTQHFVQENYLEY

SEQ ID NO: 670 - protein, 15 aa, Unknown
  Description of Unknown: immunogenic epitope
RKVAELVHFLLLKYR

SEQ ID NO: 671 - protein, 16 aa, Unknown
  Description of Unknown: immunogenic epitope
ACYEFLWGPRALVETS

SEQ ID NO: 672 - protein, 12 aa, Unknown
  Description of Unknown: immunogenic epitope
VIFSKASSSLQL

SEQ ID NO: 673 - protein, 15 aa, Unknown
  Description of Unknown: immunogenic epitope
VFGIELMEVDPIGHL

SEQ ID NO: 674 - protein, 15 aa, Unknown
  Description of Unknown: immunogenic epitope
GDNQIMPKAGLLIIV

SEQ ID NO: 675 - protein, 15 aa, Unknown
  Description of Unknown: immunogenic epitope
TSYVKVLHHMVKISG

SEQ ID NO: 676 - protein, 16 aa, Unknown
  Description of Unknown: immunogenic epitope
RKVAELVHFLLLKYRA

SEQ ID NO: 677 - protein, 37 aa, Vaccinia virus
MLNFSLCLYPVFILNKLVLRTQSIILHTINNASIKNR

What is claimed:

1. A nucleic acid comprising a recombinant orthopoxvirus genome, wherein the genome comprise deletions in each of the following 23 genes: C2L, C1L, N1L, N2L, M1L, M2L, K1L, K2L, K3L, K4L, KSL, K6L, K7R, F1L, F2L, F3L, B14R, B15R, B16R, B17L, B18R, B19R, and B20R and further comprises deletions in each of the following 9 genes: B21R, B22R, B23R, B24R, B25R, B26R, B27R, B28R, and B29R; and wherein the nucleic acid further comprises: (i) a transgene encoding a tumor-associated antigen; (ii) a transgene encoding an immune checkpoint inhibitor; (iii) a transgene encoding an interleukin (IL); (iv) a transgene encoding an interferon (IFN); (v) a transgene encoding a TNF superfamily member protein; (vi) a transgene encoding a cytokine; or (vii) any combination thereof.

2. The nucleic acid of claim 1, wherein the orthopoxvirus is a vaccinia virus and the vaccinia virus is a strain selected from the group consisting of Copenhagen, Western Reserve, Wyeth, Lister, EM63, ACAM2000, CV-1, modified vaccinia Ankara (MVA), Dairen I, GLV-1h68, IHD-J, L-IVP, LC16m8, LC16mO, Tashkent, Tian Tan, and WAU86/88-1.

3. A recombinant orthopoxvirus vector comprising the nucleic acid comprising a recombinant orthopoxvirus genome of claim 1.

4. The nucleic acid of claim 1, wherein the recombinant orthopoxvirus genome does not comprise a thymidine kinase (TK) gene deletion.

5. A packaging cell line comprising the nucleic acid of claim 1.

6. A kit comprising the nucleic acid of claim 1 and (a) a package insert instructing a user of the kit to express the nucleic acid in a host cell, or (b) a package insert instructing a user to administer a therapeutically effective amount of the nucleic acid to a mammalian patient having cancer, thereby treating the cancer.

7. The nucleic acid of claim 1, wherein the genome further comprises a deletion in the B8R gene.

8. The nucleic acid of claim 7, wherein at least one transgene is inserted into the locus of the deleted B8R gene.

9. The nucleic acid of claim 8, wherein the nucleic acid comprises at least one additional transgene other than the at least one transgene inserted into the locus of the deleted B8R gene and the at least one additional transgene is inserted at a locus that is not the locus of the B8R gene.

10. The nucleic acid of claim 1, wherein the recombinant orthopoxvirus genome does not comprise a ribonucleotide reductase gene deletion.

11. The nucleic acid of claim 1, wherein each of the deletions is a deletion of at least a portion of the polynucleotide encoding the corresponding gene that is sufficient to render the gene nonfunctional upon introduction into a host cell.

12. The nucleic acid of claim 1, wherein the orthopoxvirus is a Copenhagen strain vaccinia virus.

13. The nucleic acid of claim 1, which comprises: (i) a transgene encoding an immune checkpoint inhibitor, (ii) a transgene encoding an interleukin; (iii) a transgene encoding a cytokine; or (iv) any combination thereof.

14. The nucleic acid of claim 13, which comprises a transgene encoding an immune checkpoint inhibitor, a transgene encoding an interleukin, and a transgene encoding a cytokine, wherein the immune checkpoint inhibitor is an anti-CTLA-4 antibody or antigen-binding fragment thereof, the interleukin is selected from the group consisting of IL-12 p35, IL-12 p40, and IL-12 p'70, and the cytokine is Flt3 ligand.

15. The nucleic acid of claim 14, wherein the interleukin is IL-12 p35.

16. The nucleic acid of claim 15, wherein the interleukin is membrane-bound.

17. The nucleic acid of claim 8, wherein at least one of the following transgenes is inserted into the locus of the deleted B8R gene: a transgene encoding IL-12-TM, a transgene encoding Flt3 ligand and a transgene encoding an anti-CLTA-4 antibody or antigen-binding fragment thereof.

18. The nucleic acid of claim 9, wherein the locus that is not the locus of the B8R gene is the boundary of the following set of deletions: C2L, C1L, N1L, N2L, M1L, M2L, K1L, K2L, K3L, K4L, K5L, K6L, K7R, F1L, F2L, and F3L, or the boundary of the following set of deletions: B14R, B15R, B16R, B17L, B18R, B19R, B20R, B21R, B22R, B23R, B24R, B25R, B26R, B27R, B28R, and B29R.

19. The nucleic acid of claim 7, wherein the only deletions in the genome are deletions in the following genes: C2L, C1L, N1L, N2L, M1L, M2L, K1L, K2L, K3L, K4L, K5L, K6L, K7R, F1L, F2L, F3L, B8R, B14R, B15R, B16R, B17L, B18R, B19R, B20R, B21R, B22R, B23R, B24R, B25R, B26R, B27R, B28R, and B29R.

20. The nucleic acid of claim 7, wherein each of the deletions is a deletion of at least a portion of the polynucleotide encoding the corresponding gene that is sufficient to render the gene nonfunctional upon introduction into a host cell.

21. The nucleic acid of claim 7, wherein the orthopoxvirus is a Copenhagen strain vaccinia virus.

22. The nucleic acid of claim 19, wherein the orthopoxvirus is a Copenhagen strain vaccinia virus.

23. The nucleic acid of claim 7, which comprises: (i) a transgene encoding an immune checkpoint inhibitor, (ii) a transgene encoding an interleukin; (iii) a transgene encoding a cytokine; or (iv) any combination thereof.

24. The nucleic acid of claim 23, which comprises a transgene encoding an immune checkpoint inhibitor, a transgene encoding an interleukin, and a transgene encoding a cytokine, wherein the immune checkpoint inhibitor is an anti-CTLA-4 antibody or antigen-binding fragment thereof, the interleukin is selected from the group consisting of IL-12 p35, IL-12 p40, and IL-12 p70, and the cytokine is Flt3 ligand.

25. The nucleic acid of claim 24, wherein the interleukin is IL-12 p35.

26. The nucleic acid of claim 25, wherein the interleukin is membrane-bound.

27. A recombinant orthopoxvirus vector comprising the nucleic acid comprising a recombinant orthopoxvirus genome of claim 7.

28. A recombinant orthopoxvirus vector comprising the nucleic acid comprising a recombinant orthopoxvirus genome of claim 19.

29. The nucleic acid of claim 4, wherein each of the deletions is a deletion of at least a portion of the polynucleotide encoding the corresponding gene that is sufficient to render the gene nonfunctional upon introduction into a host cell.

30. The nucleic acid of claim 4, wherein the orthopoxvirus is a Copenhagen strain vaccinia virus.

31. The nucleic acid of claim 4, which comprises: (i) a transgene encoding an immune checkpoint inhibitor, (ii) a transgene encoding an interleukin; (iii) a transgene encoding a cytokine; or (iv) any combination thereof.

32. The nucleic acid of claim 31, which comprises a transgene encoding an immune checkpoint inhibitor, a transgene encoding an interleukin, and a transgene encoding a cytokine, wherein the immune checkpoint inhibitor is an anti-CTLA-4 antibody or antigen-binding fragment thereof, the interleukin is selected from the group consisting of IL-12 p35, IL-12 p40, and IL-12 p70, and the cytokine is Flt3 ligand.

33. The nucleic acid of claim 32, wherein the interleukin is IL-12 p35.

34. The nucleic acid of claim 33, wherein the interleukin is membrane-bound.

35. A recombinant orthopoxvirus vector comprising the nucleic acid comprising a recombinant orthopoxvirus genome of claim 4.

36. The nucleic acid of claim 4, wherein the genome further comprises a deletion in the B8R gene.

37. The nucleic acid of claim 36, wherein at least one transgene is inserted into the locus of the deleted B8R gene.

38. The nucleic acid of claim 37, wherein at least one of the following transgenes is inserted into the locus of the deleted B8R gene: a transgene encoding IL-12-TM, a transgene encoding Flt3 ligand and a transgene encoding an anti-CLTA-4 antibody or antigen-binding fragment thereof.

39. The nucleic acid of claim 37, wherein the nucleic acid comprises at least one additional transgene other than the at least one transgene inserted into the locus of the deleted B8R gene and the at least one additional transgene is inserted at a locus that is not the locus of the B8R gene.

40. The nucleic acid of claim 39, wherein the locus that is not the locus of the B8R gene is the boundary of the following set of deletions: C2L, C1L, N1L, N2L, M1L, M2L, K1L, K2L, K3L, K4L, KSL, K6L, K7R, F1L, F2L, and F3L, or the boundary of the following set of deletions: B14R, B15R, B16R, B17L, B18R, B19R, B20R, B21R, B22R, B23R, B24R, B25R, B26R, B27R, B28R, and B29R.

41. The nucleic acid of claim 36, wherein the only deletions in the genome are deletions in the following genes: C2L, C1L, N1L, N2L, M1L, M2L, K1L, K2L, K3L, K4L, K5L, K6L, K7R, F1L, F2L, F3L, B8R, B14R, B15R, B16R, B17L, B18R, B19R, B20R, B21R, B22R, B23R, B24R, B25R, B26R, B27R, B28R, and B29R.

42. The nucleic acid of claim 36, wherein each of the deletions is a deletion of at least a portion of the polynucleotide encoding the corresponding gene that is sufficient to render the gene nonfunctional upon introduction into a host cell.

43. The nucleic acid of claim 36, wherein the orthopoxvirus is a Copenhagen strain vaccinia virus.

44. The nucleic acid of claim 41, wherein the orthopoxvirus is a Copenhagen strain vaccinia virus.

45. The nucleic acid of claim 36, which comprises: (i) a transgene encoding an immune checkpoint inhibitor, (ii) a transgene encoding an interleukin; (iii) a transgene encoding a cytokine; or (iv) any combination thereof.

46. The nucleic acid of claim 45, which comprises a transgene encoding an immune checkpoint inhibitor, a transgene encoding an interleukin, and a transgene encoding a cytokine, wherein the immune checkpoint inhibitor is an anti-CTLA-4 antibody or antigen-binding fragment thereof, the interleukin is selected from the group consisting of IL-12 p35, IL-12 p40, and IL-12 p'70, and the cytokine is Flt3 ligand.

47. The nucleic acid of claim 46, wherein the interleukin is IL-12 p35.

48. The nucleic acid of claim 47, wherein the interleukin is membrane-bound.

49. A recombinant orthopoxvirus vector comprising the nucleic acid comprising a recombinant orthopoxvirus genome of claim 36.

50. A recombinant orthopoxvirus vector comprising the nucleic acid comprising a recombinant orthopoxvirus genome of claim 41.

* * * * *